US010208296B2

(12) United States Patent
Iavarone et al.

(10) Patent No.: US 10,208,296 B2
(45) Date of Patent: Feb. 19, 2019

(54) FUSION PROTEINS AND METHODS THEREOF

(71) Applicant: THE TRUSTEES OF COLUMBIA UNIVERSITY IN THE CITY OF NEW YORK, New York, NY (US)

(72) Inventors: Antonio Iavarone, New York, NY (US); Anna Lasorella, New York, NY (US); Raul Rabadan, New York, NY (US)

(73) Assignee: The Trustees of Columbia University in the City of New York, New York, NY (US)

( * ) Notice: Subject to any disclaimer, the term of this patent is extended or adjusted under 35 U.S.C. 154(b) by 360 days.

(21) Appl. No.: 14/853,568

(22) Filed: Sep. 14, 2015

(65) Prior Publication Data

US 2016/0108380 A1   Apr. 21, 2016

Related U.S. Application Data

(63) Continuation of application No. PCT/US2014/026351, filed on Mar. 13, 2014.

(60) Provisional application No. 61/793,086, filed on Mar. 15, 2013.

(51) Int. Cl.

| | |
|---|---|
| *C12N 15/62* | (2006.01) |
| *C12N 9/12* | (2006.01) |
| *C07K 14/71* | (2006.01) |
| *C07K 14/47* | (2006.01) |
| *C12N 9/16* | (2006.01) |
| *A61K 38/17* | (2006.01) |
| *A61K 31/404* | (2006.01) |
| *A61K 31/4439* | (2006.01) |
| *A61K 31/47* | (2006.01) |
| *A61K 31/496* | (2006.01) |
| *A61K 31/506* | (2006.01) |
| *A61K 31/519* | (2006.01) |
| *A61K 31/53* | (2006.01) |
| *G01N 33/574* | (2006.01) |
| *A61K 31/517* | (2006.01) |
| *C07K 14/435* | (2006.01) |
| *C07K 16/40* | (2006.01) |
| *C12Q 1/6886* | (2018.01) |
| *G01N 33/573* | (2006.01) |

(52) U.S. Cl.
CPC .............. *C12N 9/12* (2013.01); *A61K 31/404* (2013.01); *A61K 31/4439* (2013.01); *A61K 31/47* (2013.01); *A61K 31/496* (2013.01); *A61K 31/506* (2013.01); *A61K 31/517* (2013.01); *A61K 31/519* (2013.01); *A61K 31/53* (2013.01); *A61K 38/179* (2013.01); *C07K 14/435* (2013.01); *C07K 14/47* (2013.01); *C07K 14/4738* (2013.01); *C07K 14/71* (2013.01); *C07K 16/40* (2013.01); *C12N 9/16* (2013.01); *C12Q 1/6886* (2013.01); *C12Y 301/03003* (2013.01); *G01N 33/573* (2013.01); *G01N 33/57484* (2013.01); *C07K 2317/76* (2013.01); *C07K 2319/00* (2013.01); *C12Y 207/10001* (2013.01); *G01N 2333/71* (2013.01)

(58) Field of Classification Search
None
See application file for complete search history.

(56) References Cited

U.S. PATENT DOCUMENTS

| | | | |
|---|---|---|---|
| 4,683,195 | A | 7/1987 | Mullis et al. |
| 4,683,202 | A | 7/1987 | Mullis |
| 4,921,475 | A | 5/1990 | Sibalis |
| 5,008,110 | A | 4/1991 | Benecke et al. |
| 5,087,240 | A | 2/1992 | Sibalis |
| 5,088,977 | A | 2/1992 | Sibalis |
| 5,163,899 | A | 11/1992 | Sibalis |
| 5,164,189 | A | 11/1992 | Farhadieh et al. |
| 5,252,479 | A | 10/1993 | Srivastava |
| 5,254,346 | A | 10/1993 | Tucker et al. |
| 5,290,561 | A | 3/1994 | Farhadieh et al. |
| 5,328,470 | A | 7/1994 | Nabel et al. |
| 5,332,213 | A | 7/1994 | Klose |
| 5,336,168 | A | 8/1994 | Sibalis |
| 5,352,456 | A | 10/1994 | Fallon et al. |
| 5,407,713 | A | 4/1995 | Wilfong et al. |
| 5,747,469 | A | 5/1998 | Roth et al. |
| 5,780,597 | A | 7/1998 | Gately et al. |
| 5,811,523 | A | 9/1998 | Trinchieri et al. |
| 6,017,524 | A | 1/2000 | Roth et al. |
| 6,143,290 | A | 11/2000 | Zhang et al. |
| 6,410,010 | B1 | 6/2002 | Zhang et al. |
| 6,509,154 | B1 | 1/2003 | de Paillette |
| 6,511,847 | B1 | 1/2003 | Zhang et al. |
| 6,914,128 | B1 | 7/2005 | Salfeld et al. |
| 7,148,342 | B2 | 12/2006 | Tolentino et al. |

(Continued)

FOREIGN PATENT DOCUMENTS

| | | |
|---|---|---|
| JP | 2010-533205 A | 10/2010 |
| WO | WO-99/032619 | 7/1999 |

(Continued)

OTHER PUBLICATIONS

Extended European Search Report dated Jul. 25, 2016 for European Patent Application No. 14769771.8 (8 pages).

(Continued)

*Primary Examiner* — Michael Pak
(74) *Attorney, Agent, or Firm* — Wilmer Cutler Pickering Hale and Dorr LLP

(57) ABSTRACT

The invention discloses oncogenic fusion proteins. The invention provides methods for treating gene-fusion based cancers.

10 Claims, 215 Drawing Sheets

Specification includes a Sequence Listing.

(56) References Cited

U.S. PATENT DOCUMENTS

| | | | |
|---|---|---|---|
| 7,294,504 | B1 | 11/2007 | Wang |
| 7,419,661 | B2 | 9/2008 | Jahoda et al. |
| 7,422,896 | B1 | 9/2008 | Wang |
| 8,071,559 | B2 | 12/2011 | Hannon et al. |
| 2002/0077313 | A1 | 6/2002 | Clayman |
| 2002/0173478 | A1 | 11/2002 | Gewirtz |
| 2003/0027783 | A1 | 2/2003 | Zernicka-Goetz et al. |
| 2008/0312248 | A1 | 12/2008 | Bold et al. |
| 2009/0318480 | A1 | 12/2009 | Solca |
| 2010/0120678 | A1 | 5/2010 | Kuriyan et al. |
| 2011/0023143 | A1 | 1/2011 | Weinstein et al. |
| 2015/0203589 | A1 | 7/2015 | Iavarone et al. |
| 2018/0030152 | A1 | 2/2018 | Iavarone et al. |

FOREIGN PATENT DOCUMENTS

| | | |
|---|---|---|
| WO | WO-1999/35159 | 7/1999 |
| WO | WO-00/01846 | 1/2000 |
| WO | WO-00/044895 | 8/2000 |
| WO | WO-00/044914 | 8/2000 |
| WO | WO-01/029058 | 4/2001 |
| WO | WO-01/32840 | 5/2001 |
| WO | WO-2008/75068 | 6/2008 |
| WO | WO-2009/009778 | 1/2009 |
| WO | WO-2010129509 | 11/2010 |
| WO | WO-2014018673 | 1/2014 |
| WO | WO-2014/151734 | 9/2014 |
| WO | WO-2016105517 | 6/2016 |

OTHER PUBLICATIONS

Frattini et al., "The integrated landscape of driver genomic alterations in glioblastoma," Nature Genetics., vol. 45, No. 10, pp. 1141-1149 (Aug. 2013).
International Search Report and Written Opinion dated Aug. 29, 2014 for International Patent Application No. PCT/US2014/026351 (23 pages).
Liu al., "NEDD8 Modification of CUL1 Dissociates p120(CAND1), An Inhibitor of CUL1-SKP1 Binding and SCF Ligases," Molecular Cell., vol. 10, pp. 1511-1518 (Dec. 2002).
Peterson et al., "Characterization of a SEPT9 interacting protein, SEPT14, a novel testis-specific septin," Mamm. Genome., vol. 18, pp. 796-807 (Jun. 2007).
Shinoda et al., "Septin 14 Is Involved in Cortical Neuronal Migration Via Interaction with Septin 4," Molecular Biology of the Cell, vol. 21, pp. 1324-1334 (Apr. 2010).
Dallas et al., "RNAi: a novel antisense technology and its therapeutic potential," Med. Sci. Monit., 12(4), pp. RA67-RA74 (2006).
Abu-Elneel et al., "A delta-catenin signaling pathway leading to dendritic protrusions," J. Biol. Chem., 283, pp. 32781-32791 (2008).
Altaras et al., "Production and formulation of adenovirus vectors," Adv. Biochem. Eng. Biotechnol., 99, pp. 193-260 (2005).
Anderson, "Human gene therapy," Science, 256, pp. 808-813 (1992).
Anderson, "Human gene therapy," Nature, 392(6679 suppl.), pp. 25-30 (1998).
Arikkath et al., "Delta-catenin regulates spine and synapse morphogenesis and function in hippocampal neurons during development," J. Neurosci., 29, pp. 5435-5442 (2009).
Bandyopadhyay and Temin, "Expression of complete chicken thymidine kinase gene inserted in a retrovirus vector," Mol. Cell Biol., 4(4) pp. 749-754 (1984).
Barringer et al, "Blunt-end and single-strand ligations by *Escherichia coli* ligase: influence on an in vitro amplification scheme," Gene, 89, pp. 117-122 (1990).
Bass, "RNA interference. The short answer," Nature, 411, pp. 428-429 (2001).
Bass et al., "Genomic sequencing of colorectal adenocarcinomas identifies a recurrent VTI1A-TCF7L2 fusion," Nat. Genet., 43, pp. 964-968 (2011).

Bekker-Jensen et al., "HERC2 coordinates ubiquitin-dependent assembly of DNA repair factors on damaged chromosomes," Nat. Cell Biol., 12, pp. 80-86 (2010).
Kimmel and Berger, "Preparation of cDNA and the generation of cDNA libraries: overview," Methods Enzymol., 152, pp. 307-316 (1987).
Berkner, "Development of adenovirus vectors for the expression of heterologous genes," Biotechniques, 6(7), pp. 616-629 (1988).
Berkner, "Expression of heterologous sequences in adenoviral vectors," Curr. Top. Microbiol. Immunol., 158, pp. 39-66 (1992).
Beroukhim et al., "The landscape of somatic copy-number alteration across human cancers," Nature, 463, pp. 899-905 (2010).
Boyden et al. "Mutations in kelch-like 3 and cullin 3 cause hypertension and electrolyte abnormalities," Nature, 482, pp. 98-102 (2012).
Breakefield and Geller, "Gene transfer into the nervous system," Mol. Neurobiol. 1(4), pp. 339-371 (1987).
Brower, "Naked DNA vaccines come of age," Nature Biotechnology, 16, pp. 1304-1305 (1998).
Buchschacher, Jr. and Panganiban, "Human immunodeficiency virus vectors for inducible expression of foreign genes," J. Virol., 66(5) pp. 2731-2739 (1992).
Buchwald et al., "Long-term, continuous intravenous heparin administration by an implantable infusion pump in ambulatory patients with recurrent venous thrombosis," Surgery, 88, pp. 507-516 (1980).
Burg et al., "Single molecule detection of RNA reporter probes by amplification with Qbeta replicase," Mol. Cell. Probes, 10, pp. 257-271 (1996).
The Cancer Genome Atlas Research Network, "Comprehensive genomic characterization defines human glioblastoma genes and core pathways," Nature, 455, pp. 1061-1068 (2008).
Canning et al., "Structural basis for Cul3 protein assembly with the BTB-Kelch family of E3 ubiquitin ligases," J. Biol. Chem., 288, pp. 7803-7814 (2013).
Carro et al., "The transcriptional network for mesenchymal transformation of brain tumours," Nature, 463, pp. 318-325 (2010).
Chen et al., "Gene therapy for brain tumors: regression of experimental gliomas by adenovirus-mediated gene transfer in vivo," Proc. Natl. Acad. Sci. USA 91, pp. 3054-3057 (1994).
Chinnaiyan and Palanisamy "Chromosomal aberrations in solid tumors," Prog. Mol. Biol. Transl. Sci., 95, pp. 55-94 (2010).
Christ et al., "LRP2 is an auxiliary SHH receptor required to condition the forebrain ventral midline for inductive signals," Dev. Cell, 22, pp. 268-278 (2012).
Cleveland et al., "Routine large-scale production of monoclonal antibodies in a protein-free culture medium," J. Immunol. Methods, 56(2), pp. 221-234 (1983).
Cowin et al., "LRP1B deletion in high-grade serous ovarian cancers is associated with acquired chemotherapy resistance to liposomal doxorubicin," Cancer Res., 72, pp. 4060-4073 (2012).
Dunn et al., "Emerging insights into the molecular and cellular basis of glioblastoma," Genes Dev., 26, pp. 756-784 (2012).
During et al., "Controlled release of dopamine from a polymeric brain implant: in vivo characterization," Ann. Neurol., 25, 351-356 (1989).
Dzau et al., "Gene therapy for cardiovascular disease," Trends in Biotechnology, 11, pp. 205-210 (1993).
Elbashir et al., "Duplexes of 21-nucleotide RNAs mediate RNA interference in cultured mammalian cells," Nature, 411, pp. 494-498 (2001).
Eliyahu et al., "Polymers for DNA delivery," Molecules, 10(1), pp. 34-64 (2005).
Emanuele et al., "Global identification of modular cullin-RING ligase substrates," Cell, 147, pp. 459-474 (2011).
Errington et al., "Adaptor protein self-assembly drives the control of a cullin-RING ubiquitin ligase," Structure, 20, pp. 1141-1153 (2012).
Fan et al., "BCOR regulates mesenchymal stem cell function by epigenetic mechanisms," Nat. Cell Biol., 11, pp. 1002-1009 (2009) 6 pages of Supplemental Information.
Fink et al., "In vivo expression of beta-galactosidase in hippocampal neurons by HSV-mediated gene transfer.," Hum. Gene Ther. 3(1), pp. 11-19 (1992).

(56) References Cited

OTHER PUBLICATIONS

Forbes et al., "COSMIC (the Catalogue of Somatic Mutations in Cancer): a resource to investigate acquired mutations in human cancer," Nucleic Acids Res., 38, pp. D652-D657 (2010).
Freese et al., "HSV-1 vector mediated neuronal gene delivery. Strategies for molecular neuroscience and neurology," Biochem. Pharmacol., 40(10), pp. 2189-2199 (1990).
Friedmann, "Progress toward human gene therapy," Science, 244, pp. 1275-1281 (1989).
Fülöp and Jones, "Beta propellers: structural rigidity and functional diversity," Curr. Opin. Struct. Biol. 9, pp. 715-721 (1999).
Galan and Peter, "Ubiquitin-dependent degradation of multiple F-box proteins by an autocatalytic mechanism," Proc. Natl. Acad. Sci. USA 96, pp. 9124-9129 (1999).
Gavine et al., "AZD4547: an orally bioavailable, potent, and selective inhibitor of the fibroblast growth factor receptor tyrosine kinase family," Cancer Res., 72(8), pp. 2045-2056 (2012).
Gorziglia and Kapikian, "Expression of the OSU rotavirus outer capsid protein VP4 by an adenovirus recombinant," J. Virol. 66(7), pp. 4407-4412 (1992).
Guagnano et al., "Discovery of 3-(2,6-dichloro-3,5-dimethoxyphenyl)-1-{6-[4-(4-ethyl-piperazin-1-yl)-phenylamino]-pyrimidin-4-yl}-1-methyl-urea (NVP-BGJ398), a potent and selective inhibitor of the fibroblast growth factor receptor family of receptor tyrosine kinase," J. Med. Chem., 54, pp. 7066-7083 (2011).
Guatelli et al, "Isothermal, in vitro amplification of nucleic acids by a multienzyme reaction modeled after retroviral replication," PNAS, 87, pp. 1874-1878 (1990).
Gunther et al., "Glioblastoma-derived stem cell-enriched cultures form distinct subgroups according to molecular and phenotypic criteria," Oncogene, 27, pp. 2897-2909 (2008).
Harlalka et al., "Mutation of HERC2 causes developmental delay with Angelman-like features," J. Med. Genet. 50, pp. 65-73 (2013).
Helseth et al., "Changes in the transmembrane region of the human immunodeficiency virus type 1 gp41 envelope glycoprotein affect membrane fusion," J. Virol., 64(12), pp. 6314-6318 (1990).
Herweijer et al., "Gene therapy progress and prospects: hydrodynamic gene delivery," Gene Ther., 14(2), pp. 99-107 (2007).
Hicks et al., "Prediction of missense mutation functionality depends on both the algorithm and sequence alignment employed," Hum. Mutat., 32, pp. 661-668 (2011).
Hoffman, "Hydrogels for biomedical applications," Ann. NY Acad. Sci., 944, pp. 62-73 (2001).
Hoffman, "Hydrogels for biomedical applications," Adv. Drug Deliv. Rev., 54, pp. 3-12 (2002).
Howard III et al., "Intracerebral drug delivery in rats with lesion-induced memory deficits," J. Neurosurg., 71, pp. 105-112 (1989).
Hudson, "Recombinant antibody fragments," Curr. Opin. Biotechnol., 9, pp. 395-402 (1998).
Isaka et al. "Electroporation-mediated gene therapy," Expert Opin. Drug Deliv., 4(5), pp. 561-571 (2007).
Israely et al., "Deletion of the neuron-specific protein delta-catenin leads to severe cognitive and synaptic dysfunction,"Curr. Biol., 14, pp. 1657-1663 (2004).
Iyer et al., "ChimeraScan: a tool for identifying chimeric transcription in sequencing data," Bioinformatics, 27, pp. 2903-2904 (2011).
Jager et al., "Emerging adenoviral vectors for stable correction of genetic disorders," Curr. Gene Ther., 7(4), pp. 272-283 (2007).
Jensen, "Cutaneous gene therapy," Ann. Med., 39(2), pp. 108-115 (2007).
Jhoti, "Fragment-based drug discovery using rational design," Ernst Schering Found. Symp. Proc., (3), pp. 169-185 (2007).
Ji and Privé, "Crystal structure of KLHL3 in complex with Cullin3," PLoS One, 8, issue 4, e60445, pp. 1-10 (2013).
Johnson et al., "Effects of gene transfer into cultured CNS neurons with a replication-defective herpes simplex virus type 1 vector," Mol. Brain Res., 12(1-3), pp. 95-102 (1992).
Jones et al., "Application and evaluation of denaturing HPLC for molecular genetic analysis in tuberous sclerosis," Hum. Genet., 106(6), pp. 663-668 (2000).
Jun et al., "δ-Catenin is genetically and biologically associated with cortical cataract and future Alzheimer-related structural and functional brain changes," PLoS One, 7, issue 9, e43728, pp. 1-11 (2012).
Kalota et al., "Progress in the development of nucleic acid therapeutics ," Handb. Exp. Pharmacol., 173, pp. 173-196 (2006).
Kantarci et al., "Mutations in LRP2, which encodes the multiligand receptor megalin, cause Donnai-Barrow and facio-oculo-acoustico-renal syndromes," Nat. Genet. 39, pp. 957-959 (2007).
Kikuchi et al., "Cutaneous gene delivery," J. Dermatol. Sci., 50(2), pp. 87-98 (2008).
Kosik et al., "δ-catenin at the synaptic-adherens junction," Trends Cell Biol., 15, pp. 172-178 (2005).
Krejci et al., "NF449 is a novel inhibitor of fibroblast growth factor receptor 3 (FGFR3) signaling active in chondrocytes and multiple myeloma cells," The Journal of Biological Chemistry, 285(27), pp. 20644-20653 (2010).
Kwoh et al., "Transcription-based amplification system and detection of amplified human immunodeficiency virus type 1 with a bead-based sandwich hybridization format," Proc. Natl. Acad. Sci. USA, 86, pp. 1173-1177 (1989).
Landegren et al., "A ligase-mediated gene detection technique," Science, 241, pp. 1077-1080 (1988).
Langer, "New methods of drug delivery," Science, 249, pp. 1527-1533 (1990).
Lee et al., "Controlled degradation of hydrogels using multifunctional cross-linking molecules," Biomaterials, 25, pp. 2461-2466 (2004).
Levy et al., "Inhibition of calcification of bioprosthetic heart valves by local controlled-release diphosphonate," Science, 228, pp. 190-192 (1985).
Lima, F.R.S. et al. "Glioblastoma: therapeutic challenges, what lies ahead," Biochim Biophys Acta 1826, 338-349, doi:10.1016/j.bbcan.2012.05.004 (2012).
Liu et al., "Chemokine receptor CXCR3 promotes growth of glioma," Carcinogenesis, 32, pp. 129-137 (2010).
Lo et al., "Structure of the Keap1:Nrf2 interface provides mechanistic insight into Nrf2 signaling," EMBO J. 25, pp. 3605-3617 (2006).
Louis-Dit-Picard et al., "KLHL3 mutations cause familial hyperkalemic hypertension by impairing ion transport in the distal nephron," Nat. Genet., 44, pp. 456-460 (2012).
Lützelberger et al., "Strategies to identify potential therapeutic target sites in RNA," Handb. Exp. Pharmacol., 173, pp. 243-259 (2006).
Madzak et al., "Efficient in vivo encapsidation of a shuttle vector into pseudo-simian virus 40 virions using a shuttle virus as helper," J. Gen. Virol. 73( Pt 6):1533-1536 (1992).
Mann and Baltimore, "Varying the position of a retrovirus packaging sequence results in the encapsidation of both unspliced and spliced RNAs," J. Virol. 54(2), pp. 401-407 (1985).
Margolskee, "Epstein-Barr virus based expression vectors," Curr. Top. Microbiol. Immunol., 158, 67-95 (1992).
Maynard and Georgiou, "Antibody engineering," Ann. Rev. Biomed. Eng., 2, pp. 339-376 (2000).
McManus and Sharp, "Gene silencing in mammals by small interfering RNAs," Nat. Rev. Genetics, 3, pp. 737-747 (2002).
Mensch et al., "In vivo, in vitro and in silico methods for small molecule transfer across the BBB," J. Pharm. Sci. 98(12), pp. 4429-4468 (2009).
Miller, "Human gene therapy comes of age," Nature, 357, pp. 455-460 (1992).
Miller et al., "An activation-dependent, T-lymphocyte-specific transcriptional activator in the mouse mammary tumor virus env gene," Mol. Cell Biol., 12(7), pp. 3262-3272 (1992).
Miller et al., "Deletion of the gag region from FBR murine osteosarcoma virus does not affect its enhanced transforming activity," J. Virol., 55(3), pp. 521-526 (1985).
Miller et al., "Design of retrovirus vectors for transfer and expression of the human beta-globin gene," J. Virol., 62(11), pp. 4337-4345 (1988).

(56) References Cited

OTHER PUBLICATIONS

Mohammadi et al., "Crystal structure of an angiogenesis inhibitor bound to the FGF receptor tyrosine kinase domain," EMBO J., 17, pp. 5896-5904 (1998).
Moss, "Vaccinia and other poxvirus expression vectors," Curr. Opin. Biotechnol., 3(5), pp. 518-522 (1992).
Muzyczka, "Use of adeno-associated virus as a general transduction vector for mammalian cells," Curr. Top. Microbiol. Immunol., 158, pp. 97-129 (1992).
Nacak et al., "The BTB-kelch protein LZTR-1 is a novel Golgi protein that is degraded upon induction of apoptosis," J. Biol. Chem., 281, pp. 5065-5071 (2006).
Niola et al., "Mesenchymal high-grade glioma is maintained by the ID-RAPI axis," J. Clin. Invest., 123, pp. 405-417 (2013).
Northcott et al., "Subgroup-specific structural variation across 1,000 medulloblastoma genomes," Nature, 488, pp. 49-56 (2012).
Noushmehr et al., "Identification of a CpG island methylator phenotype that defines a distinct subgroup of glioma," Cancer Cell, 17, pp. 510-522 (2010).
Ohi et al., "Construction and replication of an adeno-associated virus expression vector that contains human beta-globin cDNA," Gene, 89(2), pp. 279-282 (1990).
Page et al., "Construction and use of a human immunodeficiency virus vector for analysis of virus infectivity," J. Virol., 64(11), pp. 5270-5276 (1990).
Parsons et al., "An integrated genomic analysis of human glioblastoma multiforme," Science, 321, pp. 1807-1812 (2008).
Peppas et al., "Hydrogels in Biology and Medicine: From Molecular Principles to Bionanotechnology," Adv Mater., 18: 1345-1360 (2006).
Petropoulos et al., "Using Avian Retroviral Vectors for Gene Transfer," J. Virol., 66(6), pp. 3391-3397 (1992).
Phillips et al., "Molecular subclasses of high-grade glioma predict prognosis, delineate a pattern of disease progression, and resemble stages in neurogenesis," Cancer Cell, 9, pp. 157-173 (2006).
Pierotti and Greco, "Oncogenic rearrangements of the NTRK1/NGF receptor," Cancer Lett., 232, pp. 90-98 (2006).
Porter et al., "Prevalence estimates for primary brain tumors in the United States by age, gender, behavior, and histology," Neuro-oncology, 12, pp. 520-527, (2010).
Potyrailo et al., "Combinatorial and high-throughput screening of materials libraries: review of state of the art," ACS Comb. Sci., 13(6), pp. 579-633 (2011).
Pugh et al., "Medulloblastoma exome sequencing uncovers subtype-specific somatic mutations," Nature, 488, pp. 106-110 (2012).
Quantin et al., "Adenovirus as an expression vector in muscle cells in vivo," Proc. Natl. Acad. Sci. USA, 89(7), pp. 2581-2584 (1992).
Langer and Peppas, "Chemical and Physical Structure of Polymers as Carriers for Controlled Release of Bioactive Agents: A Review," J. Macromol. Sci., Part C. Polymer Reviews, 23, pp. 61-126 (1983).
Rosenfeld et al., "In vivo transfer of the human cystic fibrosis transmembrane conductance regulator gene to the airway epithelium," Cell, 68(1), pp. 143-155 (1992).
Roy et al., "I-TASSER: a unified platform for automated protein structure and function prediction," Nat, Protoc., 5, pp. 725-738 (2010).
Rubin, A. F. & Green, P. "Mutation patterns in cancer genomes," Proc Natl Acad Sci USA 106, 21766-21770 (2009).
Saudek et al., "A preliminary trial of the programmable implantable medication system for insulin delivery," N. Engl. J. Med., 321, pp. 574-579 (1989).
Schnur, "Recent trends in library design: 'rational design' revisited," Curr. Opin, Drug Discov, Devel., 11(3), pp. 375-380 (2008).
Seal et al., "genenames.org: the HGNC resources in 2011," Nucleic Acids Res. 39, pp. D514-D519 (2011).
Sebe-Pedros et al., "Ancient origin of the integrin-mediated adhesion and signaling machinery," Proc. Natl. Acad. Sci. USA, 107, pp. 10142-10147 (2010).
Sefton, "Implantable pumps," CRC Critical Reviews in Biomed. Eng. 14, pp. 201-240 (1987).
Sen and Blau, "A brief history of RNAi: the silence of the genes," FASEB J., 20, pp. 1293-1299 (2006).
Shimada et al., "Targeted and highly efficient gene transfer into CD4+ cells by a recombinant human immunodeficiency virus retroviral vector," J. Clin. Invest., 88(3), pp. 1043-1047 (1991).
Singh et al., "Transforming fusions of FGFR and TACC genes in human glioblastoma," Science, 337, pp. 1231-1235 (2012).
Smith et al., "Detection of *Mycobacterium tuberculosis* directly from sputum by using a prototype automated Q-beta replicase assay," J. Clin. Microbiol., 35, pp. 1477-1483 (1997).
Söding, "Protein homology detection by HMM-HMM comparison," Bioinformatics, 21(7), pp. 951-960 (2005).
Sooknanan and Malek, "NASBA: A detection and amplification system uniquely suited for RNA," Nature Biotechnology, 13, pp. 563-564 (1995).
Sorge et al., "Amphotropic retrovirus vector system for human cell gene transfer," Mol. Cell. Biol., 4(9), pp. 1730-1737 (1984).
Srivastava et al., "The *Amphimedon queenslandica* genome and the evolution of animal complexity," Nature, 466, pp. 720-726 (2010).
Zhao et al., "The N-Myc-DLL3 cascade is suppressed by the ubiquitin ligase Huwe1 to inhibit proliferation and promote neurogenesis in the developing brain," Dev. Cell, 17, pp. 210-221 (2009).
Stogios et al., "Sequence and structural analysis of BTB domain proteins," Genome Biol., 6(10) pp. R82.1-R82.18 (2005).
Stratford-Perricaudet et al., "Evaluation of the transfer and expression in mice of an enzyme-encoding gene using a human adenovirus vector," Hum. Gene Ther., 1(3), pp. 241-256 (1990).
Stupp et al., "Radiotherapy plus concomitant and adjuvant temozolomide for glioblastoma," The New England Journal of Medicine, 352, pp. 987-996 (2005).
Tiacci et al., "BRAF mutations in hairy-cell leukemia," The New England Journal of Medicine, 364, pp. 2305-2315 (2011).
Verhaak et al., "Integrated genomic analysis identifies clinically relevant subtypes of glioblastoma characterized by abnormalities in PDGFRA, IDH1, EGFR, and NF1," Cancer Cell, 17, pp. 98-110 (2010).
Verma, "Gene therapy," Scientific American, 68-72, 81-84 (1990).
Vilella et al., "EnsemblCompara GeneTrees: Complete, duplication-aware phylogenetic trees in vertebrates," Genome Res., 19, pp. 327-335 (2009).
Vivanco et al., "Differential sensitivity of glioma-versus lung cancer-specific EGFR mutations to EGFR kinase inhibitors," Cancer Discov., 2, pp. 458-471 (2012).
Waehler et al., "Engineering targeted viral vectors for gene therapy," Nat. Rev. Genet., 8(8), pp. 573-587 (2007).
Wamstad and Bardwell, "Characterization of Bcor expression in mouse development," Gene Expr. Patterns, 7, pp. 550-557, (2007).
Wamstad et al., "Role of the Transcriptional Corepressor Bcor in Embryonic Stem Cell Differentiation and Early Embryonic Development," PLoS One, 3, e2814, 12 pages (2008).
Werner et al., "Joining high-throughput technology with in silico modelling advances genome-wide screening towards targeted discovery," Brief. Funct. Genomics and Proteomics, 5(1), 32-36 (2006).
Wilkinson et al., "Constitutive and enhanced expression from the CMV major IE promoter in a defective adenovirus vector," Nucleic Acids Res., 20(9), pp. 2233-2239 (1992).
Willnow et al., "Defective forebrain development in mice lacking gp330/megalin," Proc. Natl. Acad. Sci. USA, 93, pp. 8460-8464 (1996).
Wu and Wallace, "The ligation amplification reaction (LAR)—amplification of specific DNA sequences using sequential rounds of template-dependent ligation," Genomics, 4, 560-569 (1989).
Wurdak et al., "A small molecule accelerates neuronal differentiation in the adult rat," Proc. Natl. Acad. Sci. USA, 107(38), pp. 16542-16547 (2010).
Zhang et al., "Ubiquitination of Keap1, a BTB-Kelch substrate adaptor protein for Cul3, targets Keap1 for degradation by a proteasome-independent pathway," J. Biol. Chem., 280, pp. 30091-30099 (2005).
Zhang et al., "A novel retinoblastoma therapy from genomic and epigenetic analyses," Nature, 481, pp. 329-334 (2012).

(56) References Cited

OTHER PUBLICATIONS

Zhao et al., "A novel, selective inhibitor of fibroblast growth factor receptors that shows a potent broad spectrum of antitumor activity in several tumor xenograft models," Mol. Cancer Ther., 10(11), pp. 2200-2210 (2011).

Friedman et al., "Experimental Chemotherapy of Human Medulloblastoma Cell Lines and Transplantable Xenografts with Bifunctional Alkylating Agents," Cancer Res., 48, pp. 4189-4195 (8 pages) (1988).

Office Action for corresponding Japanese Patent Application No. 2016-502111 dated Mar. 27, 2018 with English language summary (6 pages).

MRPSGTAGAALLALLAALCPASRALEEKKVCQGTSNKLTQLGTFEDHFLSLQRMFNNCEVVLG
NLEITYVQRNYDLSFLKTIQEVAGYVLIALNTVERIPLENLQIIRGNMYYENSYALAVLSNYD
ANKTGLKELPMRSLQEILHGAVRFSNNPALCNVESIQWRDIVSSDFLSNMSMDFQNHLGSCQK
CDPSCPNGSCWGAGEENCQKLTKIICAQQCSGRCRGKSPSDCCHNQCAAGCTGPRESDCLVCR
KFRDEATCKDTCPPLMLYNPTTYQMDVNPEGKYSFGATCVKKCPRNYVVTDHGSCVRACGADS
YEMEEDGVRKCKKCEGPCRKVCNGIGIGEFKDSLSINATNIKHFKNCTSISGDLHILPVAFRG
DSFTHTPPLDPQELDILKTVKEITGFLLIQAWPENRTDLHAFENLEIIRGRTKQHGQFSLAVV
SLNITSLGLRSLKEISDGDVIISGNKNLCYANTINWKKLFGTSGQKTKIISNRGENSCKATGQ
VCHALCSPEGCWGPEPRDCVSCRNVSRGRECVDKCNLLEGEPREFVENSECIQCHPECLPQAM
NITCTGRGPDNCIQCAHYIDGPHCVKTCPAGVMGENNTLVWKYADAGHVCHLCHPNCTYGCTG
PGLEGCPTNGPKIPSIATGMVGALLLLLVVALGIGLPMRRRHIVRKRTLRRLLQERELVEPLT
PSGEAPNQALLRILKETEFKKIKVLGSGAFGTVYKGLWIPEGEKVKIPVAIKELREATSPKAN
KEILDEAYVMASVDNPHVCRLLGICLTSTVQLITQLMPFGCLLDYVREHKDNIGSQYLLNWCV
QIAKGMNYLEDRRLVHRDLAARNVLVKTPQHVKITDFGLAKLLGAEEKEYHAEGGKVPIKWMA
LESILHRIYTHQSDVWSYGVTVWELMTFGSKPYDGIPASEISSILEKGERLPQPPICTIDVYM
IMVKCWMIDADSRPKFRELIIEFSKMARDPQRYLVIQGDERMHLPSPTDSNFYRALMDEEDMD
DVVDADEYLIPQQGFFSSPSTSRTPLLSSLSATSNNSTVACIDRNGLQSCPIKEDSFLQRYSSDPT
GALTEDSIDDTFLPVPEYINQSVPKRPAGSVQNPVYHNQPLNPAPSRDPHYQDPHSTAVGNPE
YLNTVQPTCVNSTFDSPAHWAQKGSHQISLDNPDYQQDFFPKEAKPNGIFKGSTAENAEYLR
VAPQSSEFIGA
EGFR                                                                Septin14

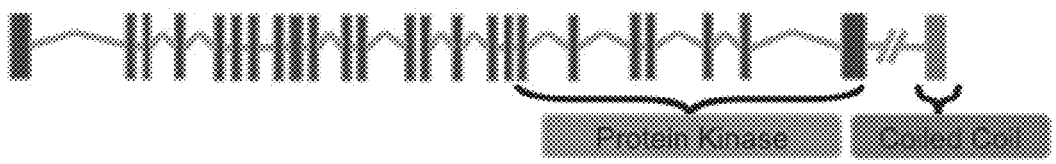

FIG. 4C

| XENOGRAFT | TREATMENT | T-C | P-VALUE | TUMOR REGRESSION | TOXIC DEATHS |
|---|---|---|---|---|---|
| D08-0537 MG EGFR-SEPT14 | ERLOTINIB | 5.63 | 0.037 | 1/10 | 0/10 |
| | LAPATINIB | 7.76 | 0.003 | 1/10 | 0/10 |
| D08-0714 MG EGFR-WT | ERLOTINIB | -1.53 | 0.323 | 0/8 | 0/8 |
| | LAPATINIB | -1.46 | 0.360 | 0/8 | 0/8 |

FIG. 5D

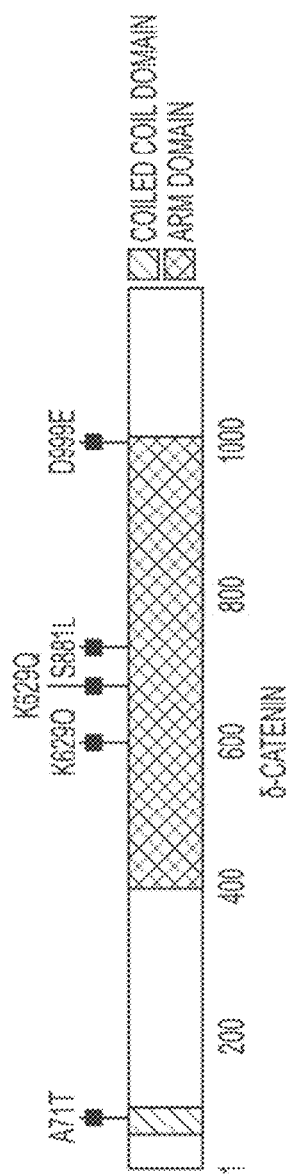

CAND1: T S A I A K Q E D V S V Q L R A L D I M A D M L S R C T G P G L E C C P T N G P K I P S I A T Q M V G X

EGFR

FIG. 14A

```
MASASYHISNLLEKMTSSDKDFRFMATNDLMTELQKDSIKLD
DDSERKVVKMILKLLEDKNGEVQNLAVKCLGPLVSKVKEYQV
ETIVDTLCTNMLSDKEQLRDISSIGLKTVIGELPPASSGSAL
AANVCKKITGRLTSAIAKQEDVSVQLEALDIMADMLSRCTGP
GLEGCPTNGPKIPSIATGMVGALLLLLVVALGIGLFMRRRHI
VRKRTLRRLLQERELVEPLTPSGEAPNQALLRILKETEFKKI
KVLGSGAFGTVYKGLWIPEGEKVKIPVAIKELREATSPKANK
EILDEAYVMASVDNPHVCRLLGICLTSTVQLITQLMPFGCLL
DYVREHKDNIGSQYLLNWCVQIAKGMNYLEDRRLVHRDLAAR
NVLVKTPQHVKITDFGLAKLLGAEEKEYHAEGGKVPIKWMAL
ESILHRIYTHQSDVWSYGVTVWELMTFGSKPYDGIPASEISS
ILEKGERLPQPPICTIDVYMIMVKCWMIDADSRPKFRELIIE
FSKMARDPQRYLVIQGDERMHLPSPTDSNFYRALMDEEDMDD
VVDADEYLIPQQGFFSSPSTSRTPLLSSLSATSNNSTVACID
RNGLQSCPIKEDSFLQRYSSDPTGALTEDSIDDTFLPVPEYI
NQSVPKRPAGSVQNPVYHNQPLNPAPSRDPHYQDPHSTAVGN
PEYLNTVQPTCVNSTFDSPAHWAQKGSHQISLDNPDYQQDFP
PKEAKPNGIFKGSTAENAEYLRVAPQSSEFIGA*
```

FIG. 14C

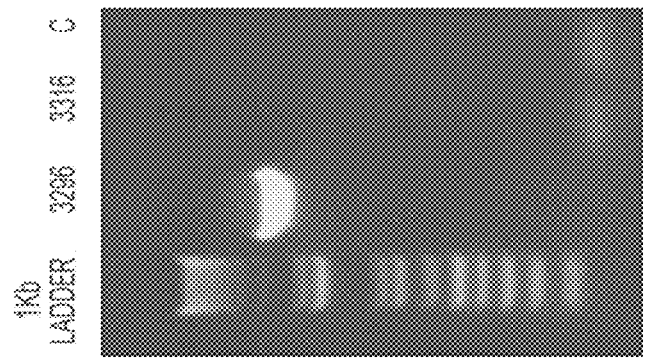
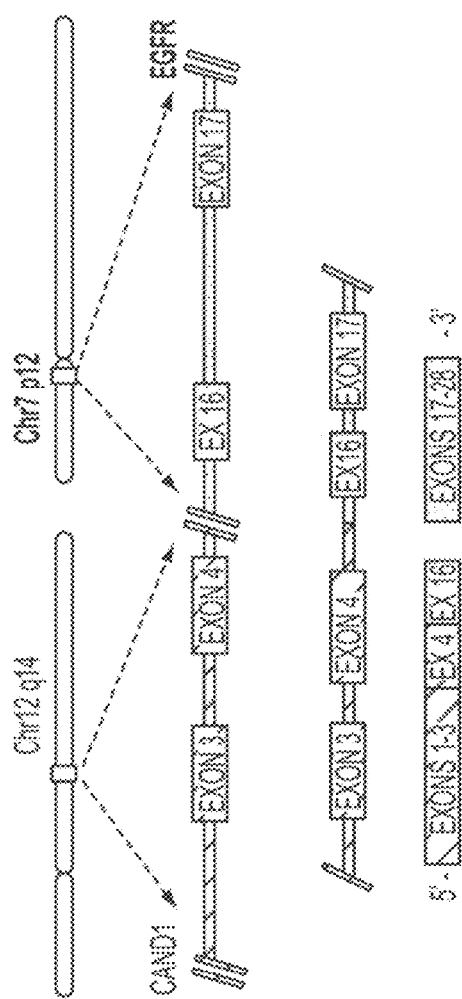
FIG. 14D

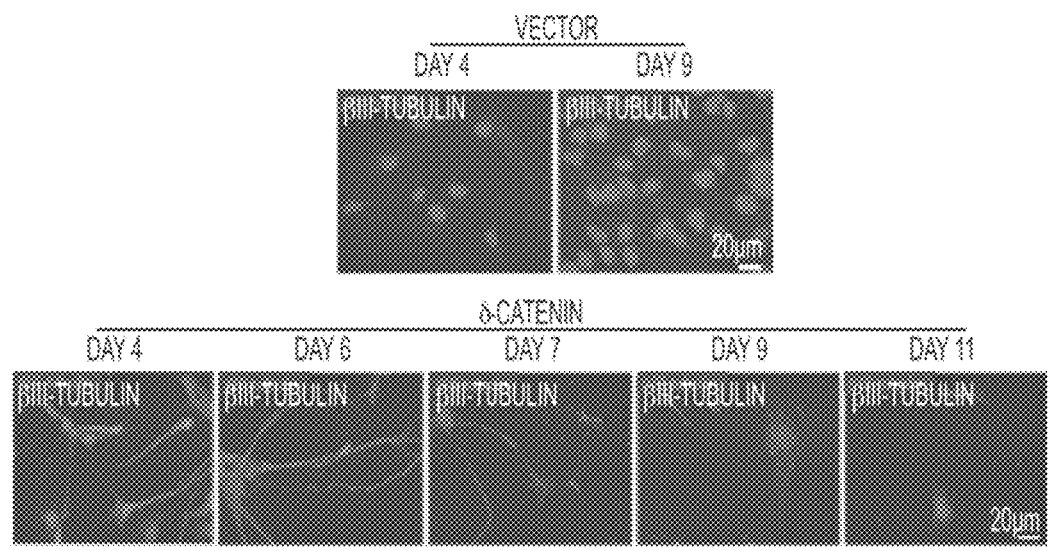
FIG. 19D
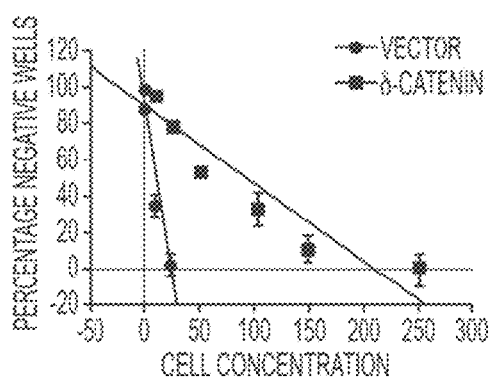 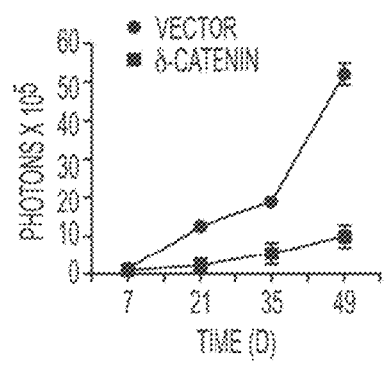
FIG. 19E FIG. 19F

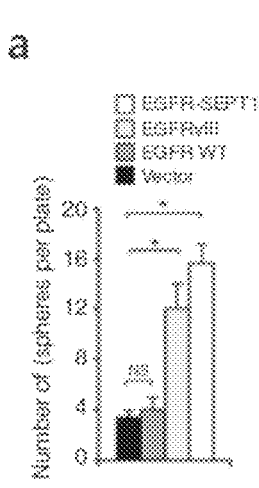 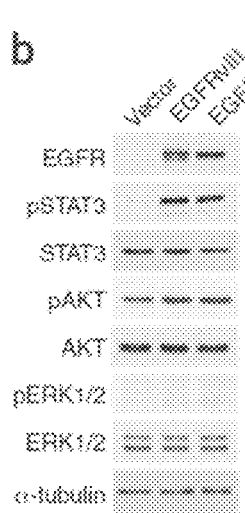 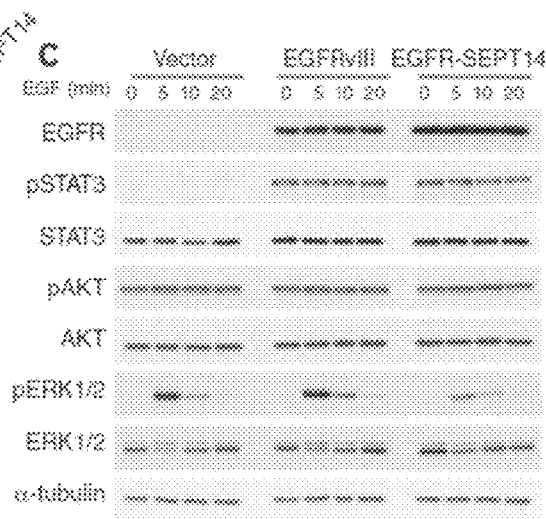
FIG. 20A    FIG. 20B    FIG. 20C
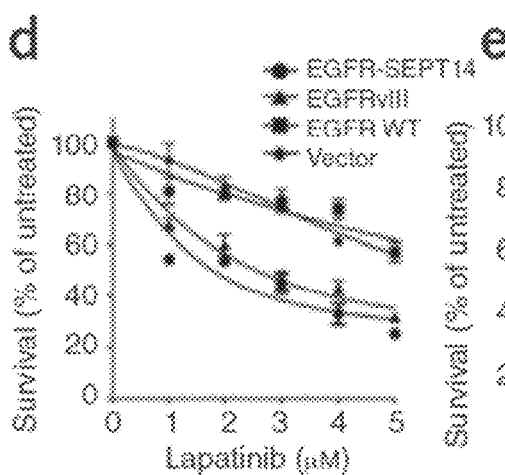 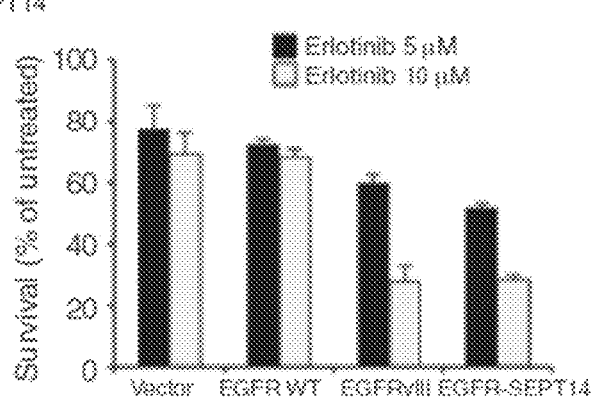
FIG. 20D    FIG. 20E

| sample | #chrom 5p | start5p | end5p | Chrom 3p | Start 3p | End 3p |
|---|---|---|---|---|---|---|
| G17807.TCGA-28-5209-01A-01R-1850-01.4 | chr7 | 55086724 | 55268105 | chr7 | 56078745 | 56079561 |
| G17197.TCGA-06-0211-01B-01R-1849-01.2 | chr7 | 55433140 | 55479781 | chr7 | 55861236 | 55886915 |
| G17650.TCGA-28-2513-01A-01R-1850-01.2 | chr7 | 55086724 | 55268105 | chr7 | 55861236 | 55863784 |
| G17506.TCGA-27-1835-01A-01R-1850-01.2 | chr4 | 1795038 | 1808660 | chr4 | 1741428 | 1746894 |
| G17191.TCGA-06-0211-01A-01R-1849-01.2 | chr7 | 55433140 | 55479781 | chr7 | 55861236 | 55886915 |
| G17512.TCGA-27-1837-01A-01R-1850-01.2 | chr7 | 55086724 | 55268105 | chr7 | 55861236 | 55863784 |
| NYU_A | chr4 | 1795038 | 1808660 | chr4 | 1737457 | 1746894 |
| G17814.TCGA-06-5411-01A-01R-1849-01.4 | chr1 | 204797781 | 204951147 | chr1 | 156844362 | 156851641 |
| Fig. G17223.TCGA-06-0750-01A-01R-1849-01.2 | chr7 | 55177539 | 55268105 | chr7 | 55861236 | 55863784 |
| G17798.TCGA-32-5222-01A-01R-1850-01.4 | chr7 | 55086724 | 55268105 | chr7 | 55861236 | 55863784 |
| G17195.TCGA-06-0138-01A-02R-1849-01.2 | chr12 | 69753531 | 69764754 | chr12 | 58339410 | 58351050 |
| G17803.TCGA-76-4925-01A-01R-1850-01.4 | chr4 | 1795038 | 1808660 | chr4 | 1739324 | 1746894 |
| NYU_B | chr17 | 7387849 | 7388175 | chr17 | 7604058 | 7605804 |
| G17507.TCGA-28-1747-01C-01R-1850-01.2 | chr7 | 55086724 | 55268105 | chr7 | 55861236 | 55863784 |
| G17469.TCGA-06-2557-01A-01R-1849-01.2 | chr7 | 73588705 | 73604247 | chr7 | 74173109 | 74175019 |
| G17785.TCGA-06-5413-01A-01R-1849-01.4 | chr14 | 32798478 | 32903022 | chr14 | 34393422 | 34400420 |
| G17467.TCGA-14-0736-02A-01R-2005-01.2 | chr14 | 102606211 | 102606508 | chr19 | 12856190 | 12859137 |
| GBM-CUMC3316_L1 | chr22 | 22160138 | 22221969 | chr12 | 58166799 | 58176322 |
| G17663.TCGA-19-2619-01A-01R-1850-01.2 | chr1 | 156611739 | 156628524 | chr1 | 156844697 | 156851641 |
| G17203.TCGA-06-0211-02A-02R-2005-01.2 | chr7 | 54825187 | 54826938 | chr7 | 55224225 | 55224641 |
| G17784.TCGA-76-4929-01A-01R-1850-01.4 | chr2 | 9675962 | 9695916 | chr2 | 9724106 | 9731643 |
| G17675.TCGA-19-2624-01A-01R-1850-01.2 | chr7 | 55086724 | 55240816 | chr12 | 65107223 | 65110598 |
| G17796.TCGA-41-5651-01A-01R-1850-01.4 | chr12 | 58166382 | 58166910 | chr12 | 58162351 | 58163738 |
| G17666.TCGA-06-5415-01A-01R-1849-01.2 | chr5 | 134209459 | 134210219 | chr2 | 219103386 | 219119069 |
| G17219.TCGA-06-0158-01A-01R-1849-01.2 | chr2 | 42396489 | 42396775 | chrX | 41374190 | 41420896 |

FIG. 27

| sample | #chrom 5p | start5p | end5p | Chrom 3p | Start 3p | End 3p |
|---|---|---|---|---|---|---|
| G17790.TCGA-06-5856-01A-01R-1849-01.4 | chr12 | 122150657 | 122150869 | chr12 | 58191442 | 58193702 |
| NYU_B | chr1 | 19746154 | 19811991 | chr1 | 19401001 | 19433459 |
| G17657.TCGA-19-1787-01B-01R-1850-01.2 | chr3 | 100428159 | 100438901 | chr3 | 100348441 | 100414320 |
| G17643.TCGA-12-5295-01A-01R-1849-01.2 | chr20 | 43976964 | 43977063 | chr3 | 52740659 | 52742194 |
| NYU_G | chr5 | 100191806 | 100238986 | chr5 | 102260660 | 102365415 |
| G17494.TCGA-14-2554-01A-01R-1850-01.2 | chr3 | 48956280 | 48965245 | chr3 | 48265843 | 48266974 |
| G17196.TCGA-06-0178-01A-01R-1849-01.2 | chr12 | 58123421 | 58135939 | chr8 | 94827532 | 94830345 |
| G17782.TCGA-26-5136-01B-01R-1850-01.4 | chr1 | 95392393 | 95392734 | chr1 | 95448278 | 95448861 |
| GBM-CUMC3296_L1 | chr7 | 55639963 | 55640199 | chr12 | 68642024 | 68645357 |
| G17199.TCGA-06-0744-01A-01R-1849-01.2 | chr7 | 55086724 | 55087057 | chr9 | 102741464 | 102784507 |
| G17792.TCGA-28-5204-01A-01R-1850-01.4 | chr4 | 6988888 | 6996028 | chr4 | 8288287 | 8298197 |
| G17476.TCGA-06-2569-01A-01R-1849-01.2 | chr6 | 7310149 | 7313540 | chrX | 31137344 | 32328392 |
| G17195.TCGA-06-0138-01A-02R-1849-01.2 | chr12 | 69139935 | 69145969 | chr12 | 58109542 | 58115337 |
| G17212.TCGA-06-0129-01A-01R-1849-01.2 | chr5 | 140855568 | 140858112 | chr6 | 163956013 | 163991168 |
| G17213.TCGA-06-0157-01A-01R-1849-01.2 | chr4 | 2061586 | 2062888 | chr16 | 90071278 | 90075837 |
| G17200.TCGA-06-0125-01A-01R-1849-01.2 | chr1 | 27022521 | 27094489 | chr14 | 24624365 | 24630546 |
| G17804.TCGA-06-5408-01A-01R-1849-01.4 | chr7 | 55086724 | 55268105 | chr7 | 56078745 | 56079561 |
| G17656.TCGA-28-2514-01A-02R-1850-01.2 | chr1 | 27022521 | 27024030 | chr1 | 49193541 | 49202123 |
| G17654.TCGA-41-4097-01A-01R-1850-01.2 | chr5 | 146017813 | 146461053 | chr1 | 156278751 | 156294879 |
| G17206.TCGA-06-0125-02A-11R-2005-01.2 | chr1 | 27022521 | 27094489 | chr14 | 24624365 | 24630546 |
| G17792.TCGA-28-5204-01A-01R-1850-01.4 | chr9 | 36190891 | 36204175 | chr9 | 33911961 | 33920398 |
| G17663.TCGA-19-2619-01A-01R-1850-01.2 | chr1 | 205719084 | 205719360 | chr1 | 205797153 | 205811016 |
| NYU_E | chr16 | 69221049 | 69333676 | chr16 | 69349910 | 69358944 |
| NYU_G | chr19 | 42759129 | 42759308 | chr19 | 42734337 | 42744293 |
| NYU_B | chr12 | 6457892 | 6473312 | chr12 | 6437923 | 6443409 |
| G17675.TCGA-19-2624-01A-01R-1850-01.2 | chr12 | 69201970 | 69230528 | chr12 | 63037762 | 63195939 |

FIG. 27 Cont.

| sample | #chrom 5p | start5p | end5p | Chrom 3p | Start 3p | End 3p |
|---|---|---|---|---|---|---|
| G17484.TCGA-14-0787-01A-01R-1849-01.2 | chr1 | 155385534 | 155532323 | chr1 | 156374054 | 156384544 |
| G17792.TCGA-28-5204-01A-01R-1850-01.4 | chr7 | 100065174 | 100076901 | chr7 | 100054237 | 100061308 |
| BT299 | chr1 | 230373330 | 230373535 | chr1 | 1246964 | 1256472 |
| G17667.TCGA-26-5134-01A-01R-1850-01.2 | chr4 | 54373483 | 54424435 | chr4 | 53457128 | 53494329 |
| GBM-CUMC3338_L1 | chr19 | 41198855 | 41207363 | chr19 | 41171813 | 41192899 |
| G17815.TCGA-19-5960-01A-11R-1850-01.4 | chr1 | 154918047 | 154928566 | chr1 | 154897208 | 154904890 |
| G17662.TCGA-32-1970-01A-01R-1850-01.2 | chr19 | 58740069 | 58758159 | chr19 | 50285013 | 50310366 |
| NYU_E | chr7 | 65540775 | 65557649 | chr7 | 65592690 | 65619550 |
| G17816.TCGA-28-5215-01A-01R-1850-01.4 | chr7 | 55086724 | 55268105 | chr7 | 56078745 | 56079561 |
| G17650.TCGA-28-2513-01A-01R-1850-01.2 | chr7 | 55431140 | 55433921 | chr7 | 55861236 | 55914329 |
| BT308 | chr20 | 33222418 | 33265088 | chr20 | 33302578 | 33303168 |
| G17656.TCGA-28-2514-01A-02R-1850-01.2 | chr7 | 55086724 | 55268105 | chr7 | 55538306 | 55588822 |
| G17639.TCGA-12-3652-01A-01R-1849-01.2 | chr9 | 33290509 | 33295424 | chr9 | 34379016 | 34382866 |
| G17796.TCGA-41-5651-01A-01R-1850-01.4 | chr12 | 58087885 | 58090155 | chr12 | 57960908 | 57978553 |
| G17468.TCGA-19-0957-02A-11R-2005-01.2 | chr1 | 61547979 | 61554351 | chr10 | 90043860 | 90122481 |
| G17790.TCGA-06-5856-01A-01R-1849-01.4 | chr13 | 20304378 | 20357082 | chr13 | 20977808 | 20987525 |
| GBM-CUMC3338_L1 | chr17 | 7465318 | 7470321 | chr17 | 7215977 | 7217039 |
| G17790.TCGA-06-5856-01A-01R-1849-01.4 | chr12 | 117175594 | 117175842 | chr12 | 69229608 | 69239210 |
| G17802.TCGA-28-5208-01A-01R-1850-01.4 | chr7 | 51203854 | 51258774 | chr7 | 55861236 | 55886915 |
| G17210.TCGA-12-0616-01A-01R-1849-01.2 | chr7 | 101006121 | 101176423 | chr7 | 30536238 | 30536850 |
| NYU_B | chr2 | 233562014 | 233613791 | chr2 | 234862560 | 234928164 |
| G17469.TCGA-06-2557-01A-01R-1849-01.2 | chr7 | 55086724 | 55268105 | chr7 | 55861236 | 55863784 |
| G17480.TCGA-27-1830-01A-01R-1850-01.2 | chr2 | 231921608 | 231945027 | chr2 | 230222345 | 230377651 |
| G17634.TCGA-19-2625-01A-01R-1850-01.2 | chr22 | 36424287 | 36424584 | chr22 | 37966253 | 37967937 |
| G17654.TCGA-41-4097-01A-01R-1850-01.2 | chr3 | 66119284 | 66313802 | chr2 | 86371055 | 86374955 |
| G17485.TCGA-14-1402-02A-01R-2005-01.2 | chr3 | 142166711 | 142166852 | chr1 | 245912644 | 246093238 |
| G17498.TCGA-02-2483-01A-01R-1849-01.2 | chr9 | 119976636 | 120177316 | chr16 | 332024 | 333367 |

FIG. 27 Cont.

| sample | #chrom 5p | start5p | end5p | Chrom 3p | Start 3p | End 3p |
|---|---|---|---|---|---|---|
| G17799.TCGA-06-1804-01A-01R-1849-01.4 | chr13 | 60971426 | 61109366 | chr13 | 47345391 | 47345630 |
| G17660.TCGA-06-5414-01A-01R-1849-01.2 | chr8 | 61591338 | 61655655 | chr8 | 59717976 | 59872566 |
| GBM-CUMC3296_L1 | chr12 | 67663060 | 67688935 | chr7 | 55238867 | 55275029 |
| G17505.TCGA-06-2564-01A-01R-1849-01.2 | chr5 | 216843 | 218296 | chr5 | 1253286 | 1282738 |
| G17798.TCGA-32-5222-01A-01R-1850-01.4 | chr1 | 11313895 | 11322607 | chr1 | 6880240 | 6932096 |
| GBM-CUMC3297_L1 | chr22 | 24640520 | 24641109 | chr22 | 18659538 | 18660159 |
| GBM-CUMC3342_L1 | chr10 | 61083747 | 61122351 | chr10 | 104375024 | 104378415 |
| G17500.TCGA-27-1831-01A-01R-1850-01.2 | chr13 | 39261172 | 39438742 | chr13 | 41790516 | 41808142 |
| G17212.TCGA-06-0129-01A-01R-1849-01.2 | chr6 | 3410421 | 3456792 | chr6 | 47199268 | 47221256 |
| GBM-CUMC3322_L1 | chr7 | 141251077 | 141255366 | chr7 | 158715067 | 158738881 |
| G17675.TCGA-19-2624-01A-01R-1850-01.2 | chr12 | 54378945 | 54379793 | chr12 | 56295196 | 56297263 |
| G17803.TCGA-76-4925-01A-01R-1850-01.4 | chr17 | 74046508 | 74068577 | chr19 | 10683347 | 10694745 |
| G17796.TCGA-41-5651-01A-01R-1850-01.4 | chr12 | 58176535 | 58186855 | chr12 | 57849876 | 57851788 |
| G17663.TCGA-19-2619-01A-01R-1850-01.2 | chr7 | 70597788 | 70800718 | chr7 | 94827660 | 94925724 |
| G17207.TCGA-06-0156-01A-03R-1849-01.2 | chr11 | 910774 | 910873 | chr16 | 4390252 | 4438631 |
| G17802.TCGA-28-5208-01A-01R-1850-01.4 | chr7 | 55433140 | 55433921 | chr7 | 56078745 | 56079561 |
| G17485.TCGA-14-1402-02A-01R-2005-01.2 | chr7 | 151216545 | 151217009 | chr7 | 151253202 | 151372722 |
| NYU_E | chr11 | 88033697 | 88070940 | chr11 | 87846430 | 87883122 |
| G17212.TCGA-06-0129-01A-01R-1849-01.2 | chr12 | 51079615 | 51128912 | chr6 | 42019094 | 42048642 |
| G17787.TCGA-26-5139-01A-01R-1850-01.4 | chr19 | 13915605 | 13920033 | chr1 | 156005092 | 156012703 |
| G17675.TCGA-19-2624-01A-01R-1850-01.2 | chr12 | 65218409 | 65232630 | chr12 | 63037762 | 63226058 |
| G17800.TCGA-06-5859-01A-01R-1849-01.4 | chr18 | 48556582 | 48586285 | chr18 | 56934268 | 56936732 |
| G17638.TCGA-28-2499-01A-01R-1850-01.2 | chr2 | 234263152 | 234299128 | chr2 | 234967479 | 234978666 |

| sample | Strand 5p | Strand 3p | Genes 5p | Genes 3p | Total frags (split inserts + split reads) | Spanning frags (split reads) |
|---|---|---|---|---|---|---|
| G17807.TCGA-28-5209-01A-01R-1850-01.4 | + | - | GGG | PSPH | 6849 | 5648 |

FIG. 27 Cont.

| sample | Strand 5p | Strand 3p | Genes 5p | Genes 3p | Total frags (split inserts + split reads) | Spanning frags (split reads) |
|---|---|---|---|---|---|---|
| G17197.TCGA-06-0211-01B-01R-1849-01.2 | + | | LANCL2 | SEPT14 | 2619 | 2078 |
| G17650.TCGA-28-2513-01A-01R-1850-01.2 | + | | EGFR | SEPT14 | 1899 | 1464 |
| G17506.TCGA-27-1835-01A-01R-1850-01.2 | + | + | FGFR3 | TACC3 | 1748 | 1604 |
| G17191.TCGA-06-0211-01A-01R-1849-01.2 | + | | LANCL2 | SEPT14 | 1367 | 1128 |
| G17512.TCGA-27-1837-01A-01R-1850-01.2 | + | | EGFR | SEPT14 | 989 | 796 |
| NYU_A | + | + | FGFR3 | TACC3 | 973 | 492 |
| G17814.TCGA-06-5411-01A-01R-1849-01.4 | + | + | KIAA0256, MFSK | NTRK1 | 841 | 751 |
| G17223.TCGA-06-0750-01A-01R-1849-01.2 | + | | EGFR | SEPT14 | 534 | 414 |
| G17798.TCGA-32-5222-01A-01R-1850-01.4 | + | | EGFR | SEPT14 | 528 | 495 |
| G17195.TCGA-06-0138-01A-02R-1849-01.2 | + | + | YEATS4 | XRCC6BP1 | 328 | 306 |
| G17803.TCGA-76-4925-01A-01R-1850-01.4 | + | + | FGFR3 | TACC3 | 303 | 203 |
| NYU_B | + | + | POLR2A | WRAP53 | 263 | 240 |
| G17507.TCGA-28-1747-01C-01R-1850-01.2 | + | | EGFR | SEPT14 | 181 | 142 |
| G17469.TCGA-06-2557-01A-01R-1849-01.2 | + | + | EIF4H | GTF2I | 180 | 142 |
| G17785.TCGA-06-5413-01A-01R-1849-01.4 | + | | AKAP6 | EGLN3 | 171 | 129 |
| G17467.TCGA-14-0736-02A-01R-2005-01.2 | + | + | WDR20 | ASNA1 | 151 | 75 |
| GBM-CUMC3316_L1 | - | + | MAPK1 | FAM119B, DKFZp586 D0919 | 145 | 96 |
| G17663.TCGA-19-2619-01A-01R-1850-01.2 | + | + | BCAN | NTRK1 | 130 | 17 |
| G17203.TCGA-06-0211-02A-02R-2005-01.2 | | + | SEC61G | EGFR | 129 | 103 |
| G17784.TCGA-76-4929-01A-01R-1850-01.4 | + | | ADAM17 | YWHAQ | 106 | 95 |
| G17675.TCGA-19-2624-01A-01R-1850-01.2 | + | | EGFR | GNS | 92 | 59 |
| G17796.TCGA-41-5651-01A-01R-1850-01.4 | + | | FAM119B, DKFZp586 D0919 | METTL1 | 29 | 18 |
| G17666.TCGA-06-5415-01A-01R-1849-01.2 | + | + | TXNDC15 | ARPC2 | 90 | 36 |
| G17219.TCGA-06-0158-01A-01R-1849-01.2 | + | | EML4 | CASK | 86 | 63 |

FIG. 27 Cont.

| sample | Strand 5p | Strand 3p | Genes 5p | Genes 3p | Total frags (split inserts + split reads) | Spanning frags (split reads) |
|---|---|---|---|---|---|---|
| G17790.TCGA-06-5856-01A-01R-1849-01.4 | + | - | TMEM120B | AVIL | 75 | 56 |
| NYU_B | | | CAPZB | UBR4 | 72 | 48 |
| G17657.TCGA-19-1787-01B-01R-1850-01.2 | + | + | TFG | GPR128 | 23 | 19 |
| G17643.TCGA-12-5295-01A-01R-1849-01.2 | | + | SDC4 | SPCS1 | 68 | 18 |
| NYU_G | | + | ST8SIA4 | PAM | 60 | 55 |
| G17494.TCGA-14-2554-01A-01R-1850-01.2 | + | + | Ari2,ARIH2 | CAMP | 59 | 52 |
| G17196.TCGA-06-0178-01A-01R-1849-01.2 | | + | AGAP2 | TMEM67 | 59 | 21 |
| G17782.TCGA-26-5136-01B-01R-1850-01.4 | | | CNN3 | ALG14 | 54 | 49 |
| GBM-CUMC3296_L1 | | | VOPP1 | IL22 | 48 | 35 |
| G17199.TCGA-06-0744-01A-01R-1849-01.2 | + | - | EGFR | ERBB4,KIA A0573 | 46 | 30 |
| G17792.TCGA-28-5204-01A-01R-1850-01.4 | + | + | TBC1D14 | HTRA3 | 45 | 33 |
| G17476.TCGA-06-2569-01A-01R-1849-01.2 | | | SSR1 | DMD | 44 | 33 |
| G17195.TCGA-06-0138-01A-02R-1849-01.2 | + | + | SLC35E3 | OS9 | 44 | 38 |
| G17212.TCGA-06-0129-01A-01R-1849-01.2 | + | + | PCDHGC3, PCDHGC4 | QKI | 43 | 24 |
| G17213.TCGA-06-0157-01A-01R-1849-01.2 | + | - | NAT8L | DBNDD1, DKFZp761 L2416 | 39 | 24 |
| G17200.TCGA-06-0125-01A-01R-1849-01.2 | + | + | ARID1A | hoip,RNF31 | 39 | 26 |
| G17804.TCGA-06-5408-01A-01R-1849-01.4 | + | | EGFR | PSPH | 38 | 37 |
| G17656.TCGA-28-2514-01A-02R-1850-01.2 | + | - | ARID1A | BEND5 | 37 | 29 |
| G17654.TCGA-41-4097-01A-01R-1850-01.2 | | | PPP2R2B | CCT3,DKF Zp667A19 6 | 37 | 18 |
| G17206.TCGA-06-0125-02A-11R-2005-01.2 | + | + | ARID1A | hoip,RNF31 | 36 | 21 |
| G17792.TCGA-28-5204-01A-01R-1850-01.4 | + | + | CLTA | UBE2R2 | 36 | 31 |
| G17663.TCGA-19-2619-01A-01R-1850-01.2 | | - | NUCKS1 | PM20D1 | 34 | 31 |
| NYU_E | + | + | SNTB2 | VPS4A | 14 | 13 |
| NYU_G | | | ERF | GSK3A | 14 | 3 |
| NYU_B | | - | SCNN1A | TNFRSF1A | 13 | 9 |

FIG. 27 Cont.

| sample | Strand 5p | Strand 3p | Genes 5p | Genes 3p | Total frags (split inserts + split reads) | Spanning frags (split reads) |
|---|---|---|---|---|---|---|
| G17675.TCGA-19-2624-01A-01R-1850-01.2 | + | - | MDM2 | PPM1H | 34 | 22 |
| G17484.TCGA-14-0787-01A-01R-1849-01.2 | | - | ASH1L | C1orf61 | 33 | 30 |
| G17792.TCGA-28-5204-01A-01R-1850-01.4 | | - | TSC22D4 | C7orf61 | 12 | 1 |
| BT299 | + | - | EPHB2 | CPSF3L | 33 | 6 |
| G17667.TCGA-26-5134-01A-01R-1850-01.2 | | - | LNX1 | USP46 | 33 | 27 |
| GBM-CUMC3338_L1 | | | ADCK4 | NUMBL | 11 | 4 |
| G17815.TCGA-19-5960-01A-11R-1850-01.4 | | - | PBXIP1 | PMVK | 10 | 8 |
| G17662.TCGA-32-1970-01A-01R-1850-01.2 | + | + | ZNF544 | DKFZp586H1320,AP2A1 | 31 | 28 |
| NYU_E | + | + | ASL | CRCP | 10 | 8 |
| G17816.TCGA-28-5215-01A-01R-1850-01.4 | + | - | EGFR | PSPH | 31 | 28 |
| G17650.TCGA-28-2513-01A-01R-1850-01.2 | + | - | LANCL2 | SEPT14 | 31 | 14 |
| BT308 | | - | PIGU | NCOA6 | 30 | 26 |
| G17656.TCGA-28-2514-01A-02R-1850-01.2 | + | - | EGFR | GASP,VOPP1 | 29 | 23 |
| G17639.TCGA-12-3652-01A-01R-1849-01.2 | + | - | NFX1 | C9orf24 | 28 | 20 |
| G17796.TCGA-41-5651-01A-01R-1850-01.4 | + | + | OS9 | KIF5A | 28 | 23 |
| G17468.TCGA-19-0957-02A-11R-2005-01.2 | + | - | NFIA | RNLS,C10orf59 | 27 | 14 |
| G17790.TCGA-06-5856-01A-01R-1849-01.4 | | - | PSPC1 | CRYL1 | 26 | 18 |
| GBM-CUMC3338_L1 | + | - | SENP3 | GPS2,KIAA1787 | 26 | 15 |
| G17790.TCGA-06-5856-01A-01R-1849-01.4 | | + | C12orf49 | MDM2 | 26 | 16 |
| G17802.TCGA-28-5208-01A-01R-1850-01.4 | | - | COBL | SEPT14 | 23 | 15 |
| G17210.TCGA-12-0616-01A-01R-1849-01.2 | + | - | EMID2 | GGCT | 22 | 16 |
| NYU_B | + | + | KIAA0642,GIGYF2 | TRPM8 | 22 | 20 |
| G17469.TCGA-06-2557-01A-01R-1849-01.2 | + | - | EGFR | SEPT14 | 21 | 13 |
| G17480.TCGA-27-1830-01A-01R-1850-01.2 | + | - | PSMD1 | DNER | 20 | 14 |
| G17634.TCGA-19-2625-01A-01R-1850-01.2 | | - | RBM9 | LGALS2 | 20 | 16 |

FIG. 27 Cont.

| sample | Strand 5p | Strand 3p | Genes 5p | Genes 3p | Total frags (split inserts + split reads) | Spanning frags (split reads) |
|---|---|---|---|---|---|---|
| G17654.TCGA-41-4097-01A-01R-1850-01.2 | + | - | SLC25A26 | IMMT | 19 | 17 |
| G17485.TCGA-14-1402-02A-01R-2005-01.2 | - | - | XRN1 | SMYD3 | 19 | 11 |
| G17498.TCGA-02-2483-01A-01R-1849-01.2 | - | + | ASTN2 | ARHGDIG, PDIA2 | 18 | 6 |
| G17799.TCGA-06-1804-01A-01R-1849-01.4 | + | - | TDRD3 | ESD | 18 | 13 |
| G17660.TCGA-06-5414-01A-01R-1849-01.2 | + | - | CHD7 | TOX | 18 | 16 |
| GBM-CUMC3296_L1 | + | + | CARD1 | EGFR | 17 | 14 |
| G17505.TCGA-06-2564-01A-01R-1849-01.2 | - | - | CCDC127 | hTERT,TERT | 17 | 12 |
| G17798.TCGA-32-5222-01A-01R-1850-01.4 | - | + | MTOR | KIAA0833, CAMTA1 | 17 | 13 |
| GBM-CUMC3297_L1 | - | + | DKFZp5660011,GGTS | USP18 | 16 | 6 |
| GBM-CUMC3342_L1 | - | + | FAM13C | DKFZp434E2022,SUFU | 15 | 11 |
| G17500.TCGA-27-1831-01A-01R-1850-01.2 | + | - | FREM2 | MTRF1 | 15 | 14 |
| G17212.TCGA-06-0129-01A-01R-1849-01.2 | - | - | SLC22A23, DKFZp434F011 | TNFRSF21 | 15 | 11 |
| GBM-CUMC3322_L1 | + | + | AGK | WDR60 | 15 | 12 |
| G17675.TCGA-19-2624-01A-01R-1850-01.2 | + | - | HOXC10 | WIBG | 15 | 10 |
| G17803.TCGA-76-4925-01A-01R-1850-01.4 | - | - | SRP68 | AP1M2 | 14 | 8 |
| G17796.TCGA-41-5651-01A-01R-1850-01.4 | + | + | TSFM | INHBE | 14 | 9 |
| G17663.TCGA-19-2619-01A-01R-1850-01.2 | + | + | WBSCR17 | PPP1R9A | 14 | 10 |
| G17207.TCGA-06-0156-01A-03R-1849-01.2 | - | - | CHID1 | Magmas,hCG_1787779,CORO7 | 13 | 13 |
| G17802.TCGA-28-5208-01A-01R-1850-01.4 | + | - | LANCL2 | PSPH | 13 | 2 |
| G17485.TCGA-14-1402-02A-01R-2005-01.2 | - | - | RHEB | H91620,PRKAG2 | 12 | 11 |
| NYU_E | - | - | CTSC | RAB38 | 12 | 11 |
| G17212.TCGA-06-0129-01A-01R-1849-01.2 | + | + | DIP2B | TAF8 | 12 | 7 |
| G17787.TCGA-26-5139-01A-01R-1850-01.4 | + | - | ZSWIM4 | UBQLN4 | 11 | 9 |

FIG. 27 Cont.

| sample | Strand 5p | Strand 3p | Genes 5p | Genes 3p | Total frags (split inserts + split reads) | Spanning frags (split reads) |
|---|---|---|---|---|---|---|
| G17675.TCGA-19-2624-01A-01R-1850-01.2 | + | | TBC1D30, KIAA0984 | PPM1H | 10 | 6 |
| G17800.TCGA-06-5859-01A-01R-1849-01.4 | + | | SMAD4 | RAX | 10 | 10 |
| G17638.TCGA-28-2499-01A-01R-1850-01.2 | + | + | DGKD | SPP2 | 10 | 10 |

| sample | Gene Breakpoint 5p | Gene Breakpoint 3p | Frame Type | SEQ ID NO: | Fused Sequence |
|---|---|---|---|---|---|
| G17807. TCGA-28-5209-01A-01R-1850-01.4 | 55268106 | 56079562 | InFrame | 8276 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA AATCATCTGTGCCCAGCAGTGCTCCGGGCGCTGCCGTG GCAAGTCCCCCAGTGACTGCTGCCACAACCAGTGTGCT GCAGGCTGCACAGGCCCCCGGGGAGAGCGACTGCCTG GTCTGCCGCAAATTCCGAGACGAAGCCACGTGCAAGG ACACCTGCCCCCCACTCATGCTCTACAACCCCACCACGT ACCAGATGGATGTGAACCCCGAGGGCAAATACAGCTT TGGTGCCACCTGCGTGAAGAAGTGTCCCCGTAATTATG TGGTGACAGATCACGGCTCGTGCGTCCGAGCCTGTGG GGCCGACAGCTATGAGATGGAGGAAGACGGCGTCCG CAAGTGTAAGAAGTGCGAAGGGCCTTGCCGCAAAGTG TGTAACGGAATAGGTATTGGTGAATTTAAAGACTCACT CTCCATAAATGCTACGAATATTAAACACTTCAAAAACT GCACCTCCATCAGTGGCGATCTCCACATCCTGCCGGTG GCATTTAGGGGTGACTCCTTCACACATACTCCTCCTCTG GATCCACAGGAACTGGATATTCTGAAAACCGTAAGG AAATCACAGGGTTTTTGCTGATTCAGGCTTGGCCTGAA AACAGGACGGACCTCCATGCCTTTGAGAACCTAGAAA TCATACGCGGCAGGACCAAGCAACATGGTCAGTTTTCT CTTGCAGTCGTCAGCCTGAACATAACATCCTTGGGATT ACGCTCCCTCAAGGAGATAAGTGATGGAGATGTGATA ATTTCAGGAAACAAAAATTTGTGCTATGCAAATACAAT AAACTGGAAAAAACTGTTTGGGACCTCCGGTCAGAAA ACCAAAATTATAAGCAACAGAGGTGAAAACAGCTGCA AGGCCACAGGCCAGGTCTGCCATGCCTTGTGCTCCCCC GAGGGCTGCTGGGGCCCCGGAGCCCAGGGACTGCGTC TCTTGCCGGAATGTCAGCCGAGGCAGGGAATGCGTGG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | ACAAGTGCAACCTTCTGGAGGGTGAGCCAAGGGAGTT TGTGGAGAACTCTGAGTGCATACAGTGCCACCCAGAG TGCCTGCCTCAGGCCATGAACATCACCTGCACAGGACG GGGACCAGACAACTGTATCCAGTGTGCCCACTACATTG ACGGCCCCCACTGCGTCAAGACCTGCCCGGCAGGAGT CATGGGAGAAAACAACACCCTGGTCTGGAAGTACGCA GACGCCGGCCATGTGTGCCACCTGTGCCATCCAAACTG CACCTACGGATGCACTGGGCCAGGTCTTGAAGGCTGT CCAACGAATGGGCCTAAGATCCCGTCCATCGCCACTGG GATGGTGGGGCCCTCCTCTTGCTGCTGGTGGTGGCC CTGGGGATCGGCCTCTTCATGCGAAGGCGCCACATCG TTCGGAAGCGCACGCTGCGGAGGCTGCTGCAGGAGA GGGAGCTTGTGGAGCCTCTTACACCCAGTGGAGAAGC TCCCAACCAAGCTCTCTTGAGGATCTTGAAGGAAACTG AATTCAAAAAGATCAAAGTGCTGGGCTCCGGTGCGTT CGGCACGGTGTATAAGGGACTCTGGATCCCAGAAGGT GAGAAAGTTAAAATTCCCGTCGCTATCAAGGAATTAA GAGAAGCAACATCTCCGAAAGCCAACAAGGAAATCCT CGATGAAGCCTACGTGATGGCCAGCGTGGACAACCCC CACGTGTGCCGCCTGCTGGGCATCTGCCTCACCTCCAC CGTGCAGCTCATCACGCAGCTCATGCCCTTCGGCTGCC TCCTGGACTATGTCCGGGAACACAAAGACAATATTGG CTCCCAGTACCTGCTCAACTGGTGTGTGCAGATCGCAA AGGGCATGAACTACTTGGAGGACCGTCGCTTGGTGCA CCGCGACCTGGCAGCCAGGAACGTACTGGTGAAAACA CCGCAGCATGTCAAGATCACAGATTTTGGGCTGGCCA AACTGCTGGGTGCGGAAGAGAAAGAATACCATGCAG AAGGAGGCAAAGTGCCTATCAAGTGGATGGCATTGGA ATCAATTTTACACAGAATCTATACCCACCAGAGTGATG TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|GATGCT TTCATTGGATTTGGAGGAAATGTGATCAGGCAACAAG TCAAGGATAACGCCAAATGGTATATCACTGATTTTGTA GAGCTGCTGGGAGAACTGGAAGAA |
| G17197. TCGA-06- 0211- 01B-01R- 1849- 01.2 | 55479782 | 55886916 | InFrame | 8277 | ATGGGCGAGACCATGTCAAAGAGGCTGAAGCTCCACC TGGGAGGGGAGGCAGAAATGGAGGAACGGGCGTTCG TCAACCCCTTCCCGGACTACGAGGCCGCCGCCGGGGC GCTGCTCGCCTCCGGAGCGGCCGAAGAGACAGGCTGT GTTCGTCCCCCGGCGACCACGGATGAGCCCGGCCTCCC TTTTCATCAGGACGGGAAGATCATTCATAATTTCATAA GACGGATCCAGACCAAAATTAAAGATCTTCTGCAGCA AATGGAAGAAGGGCTGAAGACAGCTGATCCCCATGAC TGCTCTGCTTATACTGGCTGGACAGGCATAGCCCTTTT GTACCTGCAGTTGTACCGGGTCACATGTGACCAAACCT ACCTGCTCCGATCCCTGGATTACGTAAAAAGAACACTT CGGAATCTGAATGGCCGCAGGGTCACCTTCCTCTGTGG GGATGCTGGCCCCTGGCTGTTGGAGCTGTGATTTATC ACAAACTCAGAAGTGACTGTGAGTCCCAGGAATGTGT CACAAAACTTTTGCAGCTCCAGAGATCGGTTGTCTGCC AAGAATCAGACCTTCCTGATGAGCTGCTTTATGGACGG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GCAGGTTATCTGTATGCCTTACTGTACCTGAACACAGA GATAGGTCCAGGCACCGTGTGTGAGTCAGCTATTAAA GAGGTAGTCAATGCTATTATTGAATCGGGTAAGACTTT GTCAAGGGAAGAAAGAAAAACGGAGCGCTGCCCGCT GTTGTACCAGTGGCACCGGAAGCAGTACGTTGGAGCA GCCCATGGCATGGCTGGAATTTACTATATGTTAATGCA GCCGGCAGCAAAAGTGGACCAAGAAACCTTGACAGAA ATGGTGAAACCCAGTATTGATTATGTGCGCCACAAAAA ATTCCGATCTGGGAATTACCCATCATCATTAAGCAATG AAACAGACCGGCTGGTGCACTGGTGCCACGGCGCCCC GGGGGTCATCCACATGCTCATGCAGGCGTACAAG\|GG GCTGTTACCCTTTGCTGTGGTAGGGAGTACAGATGAA GTGAAAGTTGGAAAAAGGATGGTCAGAGGCCGTCACT ACCCTTGGGGAGTTTTGCAAGTGGAAAATGAAAATCA CTGTGACTTCGTTAAGCTCCGAGATATGCTTCTTTGTAC CAATATGGAAAATCTAAAAGAAAAAACCCACACTCAG CACTATGAATGTTATAGGTACCAAAAACTGCAGAAAAT GGGCTTTACAGATGTGGGTCCAAACAACCAGCCAGTT AGTTTTCAAGAAATCTTTGAAGCCAAAAGACAAGAGTT CTATGATCAATGTCAGAGGGAAGAAGAAGAGTTGAAA CAGAGATTTATGCAGCGAGTCAAGGAGAAAGAAGCAA CATTTAAAGAAGCTGAAAAAGAGCTGCAGGACAAGTT CGAGCATCTTAAAATGATTCAACAGGAGGAGATAAGG AAGCTCGAGGAAGAGAAAAAACAACTGGAAGGAGAA ATCATAGATTTTTATAAAATGAAAGCTGCCTCCGAAGC ACTGCAGACTCAGCTGAGCACCGATACAAAGAAAGAC AAACATCGTAAGAAA |
| G17650. TCGA-28-2513-01A-01R-1850-01.2 | 55268106 | 55863785 | InFrame | 8278 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA AATCATCTGTGCCCAGCAGTGCTCCGGGCGCTGCCGTG GCAAGTCCCCCAGTGACTGCTGCCACAACCAGTGTGCT GCAGGCTGCACAGGCCCCCGGGAGAGCGACTGCCTG GTCTGCCGCAAATTCCGAGACGAAGCCACGTGCAAGG ACACCTGCCCCCCACTCATGCTCTACAACCCCACCACGT ACCAGATGGATGTGAACCCCGAGGGCAAATACAGCTT TGGTGCCACCTGCGTGAAGAAGTGTCCCCGTAATTATG TGGTGACAGATCACGGCTCGTGCGTCCGAGCCTGTGG GCCGACAGCTATGAGATGGAGGAAGACGGCGTCCG CAAGTGTAAGAAGTGCGAAGGGCCTTGCCGCAAAGTG TGTAACGGAATAGGTATTGGTGAATTTAAAGACTCACT |

| sample | Gene Breakpoint 5p | Gene Breakpoint 3p | Frame Type | SEQ ID NO: | Fused Sequence |
|---|---|---|---|---|---|
| | | | | | CTCCATAAATGCTACGAATATTAAACACTTCAAAAACT<br>GCACCTCCATCAGTGGCGATCTCCACATCCTGCCGGTG<br>GCATTTAGGGGTGACTCCTTCACACATACTCCTCCTCTG<br>GATCCACAGGAACTGGATATTCTGAAAACCGTAAAGG<br>AAATCACAGGGTTTTTGCTGATTCAGGCTTGGCCTGAA<br>AACAGGACGGACCTCCATGCCTTTGAGAACCTAGAAA<br>TCATACGCGGCAGGACCAAGCAACATGGTCAGTTTTCT<br>CTTGCAGTCGTCAGCCTGAACATAACATCCTTGGGATT<br>ACGCTCCCTCAAGGAGATAAGTGATGGAGATGTGATA<br>ATTTCAGGAAACAAAAATTTGTGCTATGCAAATACAAT<br>AAACTGGAAAAAACTGTTTGGGACCTCCGGTCAGAAA<br>ACCAAAATTATAAGCAACAGAGGTGAAAACAGCTGCA<br>AGGCCACAGGCCAGGTCTGCCATGCCTTGTGCTCCCCC<br>GAGGGCTGCTGGGGCCCGGAGCCCAGGGACTGCGTC<br>TCTTGCCGGAATGTCAGCCGAGGCAGGGAATGCGTGG<br>ACAAGTGCAACCTTCTGGAGGGTGAGCCAAGGGAGTT<br>TGTGGAGAACTCTGAGTGCATACAGTGCCACCCAGAG<br>TGCCTGCCTCAGGCCATGAACATCACCTGCACAGGACG<br>GGGACCAGACAACTGTATCCAGTGTGCCCACTACATTG<br>ACGGCCCCCACTGCGTCAAGACCTGCCCGGCAGGAGT<br>CATGGGAGAAAACAACACCCTGGTCTGGAAGTACGCA<br>GACGCCGGCCATGTGTGCCACCTGTGCCATCCAAACTG<br>CACCTACGGATGCACTGGGCCAGGTCTTGAAGGCTGT<br>CCAACGAATGGGCCTAAGATCCCGTCCATCGCCACTGG<br>GATGGTGGGGCCCTCCTCTTGCTGCTGGTGGTGGCC<br>CTGGGGATCGGCCTCTTCATGCGAAGGCGCCACATCG<br>TTCGGAAGCGCACGCTGCGGAGGCTGCTGCAGGAGA<br>GGGAGCTTGTGGAGCCTCTTACACCCAGTGGAGAAGC<br>TCCCAACCAAGCTCTCTTGAGGATCTTGAAGGAAACTG<br>AATTCAAAAAGATCAAAGTGCTGGGCTCCGGTGCGTT<br>CGGCACGGTGTATAAGGGACTCTGGATCCCAGAAGGT<br>GAGAAAGTTAAAATTCCCGTCGCTATCAAGGAATTAA<br>GAGAAGCAACATCTCCGAAAGCCAACAAGGAAATCCT<br>CGATGAAGCCTACGTGATGGCCAGCGTGGACAACCCC<br>CACGTGTGCCGCCTGCTGGGCATCTGCCTCACCTCCAC<br>CGTGCAGCTCATCACGCAGCTCATGCCCTTCGGCTGCC<br>TCCTGGACTATGTCCGGGAACACAAAGACAATATTGG<br>CTCCCAGTACCTGCTCAACTGGTGTGTGCAGATCGCAA<br>AGGGCATGAACTACTTGGAGGACCGTCGCTTGGTGCA<br>CCGCGACCTGGCAGCCAGGAACGTACTGGTGAAAACA<br>CCGCAGCATGTCAAGATCACAGATTTTGGGCTGGCCA<br>AACTGCTGGGTGCGGAAGAGAAAGAATACCATGCAG<br>AAGGAGGCAAAGTGCCTATCAAGTGGATGGCATTGGA<br>ATCAATTTTACACAGAATCTATACCCACCAGAGTGATG<br>TCTGGAGCTACGGGGTGACTGTTTGGGAGTTGATGAC<br>CTTTGGATCCAAGCCATATGACGGAATCCCTGCCAGCG<br>AGATCTCCTCCATCCTGGAGAAAGGAGAACGCCTCCCT<br>CAGCCACCCATATGTACCATCGATGTCTACATGATCAT<br>GGTCAAGTGCTGGATGATAGACGCAGATAGTCGCCCA<br>AAGTTCCGTGAGTTGATCATCGAATTCTCCAAAATGGC<br>CCGAGACCCCCAGCGCTACCTTGTCATTCAG\|CTGCAG<br>GACAAGTTCGAGCATCTTAAAATGATTCAACAGGAGG<br>AGATAAGGAAGCTCGAGGAAGAGAAAAAACAACTGG<br>AAGGAGAAATCATAGATTTTTATAAAATGAAAGCTGCC |

FIG. 27 Cont.

| sample | Gene Break-point 5p | Gene Break-point 3p | Frame Type | SEQ ID NO: | Fused Sequence |
|---|---|---|---|---|---|
| | | | | | TCCGAAGCACTGCAGACTCAGCTGAGCACCGATACAAAGAAAGACAAACATCGTAAGAAA |
| G17506. TCGA-27-1835-01A-01R-1850-01.2 | 1803661 | 1741429 | InFrame | 8279 | ATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGTCCTGGATCAGTGAGAGTGTGGAGGCCGACGTGCGCCTCCGCCTGGCCAATGTGTCGGAGCGGGACGGGGGCGAGTACCTCTGTCGAGCCACCAATTTCATAGGCGTGGCCGAGAAGGCCTTTTGGCTGAGCGTTCACGGGCCCCGAGCAGCCGAGGAGGAGCTGGTGGAGGCTGACGAGGCGGGCAGTGTGTATGCAGGCATCCTCAGCTACGGGGTGGGCTTCTTCCTGTTCATCCTGGTGGTGGCGGCTGTGACGCTCTGCCGCCTGCGCAGCCCCCCCAAGAAAGGCCTGGGCTCCCCCACCGTGCACAAGATCTCCCGCTTCCCGCTCAAGCGACAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTgcgggcgcggcggccccgggccTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAAC |

FIG. 27 Cont.

| sample | Gene Break-point 5p | Gene Break-point 3p | Frame Type | SEQ ID NO: | Fused Sequence |
|---|---|---|---|---|---|
| | | | | | GGCCGGCTGCCCGTGAAGTGGATGGCGCCTGAGGCCT TGTTTGACCGAGTCTACACTCACCAGAGTGACGTCTGG TCCTTTGGGGTCCTGCTCTGGGAGATCTTCACGCTGGG GGGCTCCCCGTACCCCGGCATCCCTGTGGAGGAGCTCT TCAAGCTGCTGAAGGAGGGCCACCGCATGGACAAGCC CGCCAACTGCACACACGACCTGTACATGATCATGCGG GAGTGCTGGCATGCCGCGCCCTCCCAGAGGCCCACCTT CAAGCAGCTGGTGGAGGACCTGGACCGTGTCCTTACC GTGACGTCCACCGAC\|GTAAAGGCGACACAGGAGGAG AACCGGGAGCTGAGGAGCAGGTGTGAGGAGCTCCAC GGGAAGAACCTGGAACTGGGGAAGATCATGGACAGG TTCGAAGAGGTTGTGTACCAGGCCATGGAGGAAGTTC AGAAGCAGAAGGAACTTTCCAAAGCTGAAATCCAGAA AGTTCTAAAAGAAAAAGACCAACTTACCACAGATCTGA ACTCCATGGAGAAGTCCTTCTCCGACCTCTTCAAGCGT TTTGAGAAACAGAAAGAGGTGATCGAGGGCTACCGCA AGAACGAAGAGTCACTGAAGAAGTGCGTGGAGGATT ACCTGGCAAGGATCACCCAGGAGGGCCAGAGGTACCA AGCCCTGAAGGCCCACGCGGAGGAGAAGCTGCAGCT GGCAAACGAGGAGATCGCCCAGGTCCGGAGCAAGGC CCAGGCGGAAGCGTTGGCCCTCCAGGCCAGCCTGAGG AAGGAGCAGATGCGCATCCAGTCGCTGGAGAAGACA GTGGAGCAGAAGACTAAAGAGAACGAGGAGCTGACC AGGATCTGCGACGACCTCATCTCCAAGATGGAGAAGA TC |
| G17191. TCGA-06-0211-01A-01R-1849-01.2 | 55479782 | 55886916 | InFrame | 8280 | ATGGGCGAGACCATGTCAAAGAGGCTGAAGCTCCACC TGGGAGGGGAGGCAGAAATGGAGGAACGGGCGTTCG TCAACCCCTTCCCGGACTACGAGGCCGCGCCGGGGGC GCTGCTCGCCTCCGGAGCGGCCGAAGAGACAGGCTGT GTTCGTCCCCCGGCGACCACGGATGAGCCCGGCCTCCC TTTTCATCAGGACGGGAAGATCATTCATAATTTCATAA GACGGATCCAGACCAAAATTAAAGATCTTCTGCAGCA AATGGAAGAAGGGCTGAAGCAGCTGATCCCCATGAC TGCTCTGCTTATACTGGCTGGACAGGCATAGCCCTTTT GTACCTGCAGTTGTACCGGGTCACATGTGACCAAACCT ACCTGCTCCGATCCCTGGATTACGTAAAAAGAACACTT CGGAATCTGAATGGCCGCAGGGTCACCTTCCTCTGTGG GGATGCTGGCCCCCTGGCTGTTGGAGCTGTGATTTATC ACAAACTCAGAAGTGACTGTGAGTCCCAGGAATGTGT CACAAAACTTTTGCAGCTCCAGAGATCGGTTGTCTGCC AAGAATCAGACCTTCCTGATGAGCTGCTTTATGGACGG GCAGGTTATCTGTATGCCTTACTGTACCTGAACACAGA GATAGGTCCAGGCACCGTGTGTGAGTCAGCTATTAAA GAGGTAGTCAATGCTATTATTGAATCGGGTAAGACTTT GTCAAGGGAAGAAAGAAAAACGGAGCGCTGCCCGCT GTTGTACCAGTGGCACCGGAAGCAGTACGTTGGAGCA GCCCATGGCATGGCTGGAATTTACTATATGTTAATGCA GCCGGCAGCAAAAGTGGACCAAGAAACCTTGACAGAA ATGGTGAAACCCAGTATTGATTATGTGCGCCACAAAAA ATTCCGATCTGGGAATTACCCATCATCATTAAGCAATG AAACAGACCGGCTGGTGCACTGGTGCCACGGCGCCCC GGGGGTCATCCACATGCTCATGCAGGCGTACAAG\|GG GCTGTTACCCTTTGCTGTGGTAGGGAGTACAGATGAA GTGAAAGTTGGAAAAAGGATGGTCAGAGGCCGTCACT ACCCTTGGGGAGTTTTGCAAGTGGAAAATGAAAATCA |

FIG. 27 Cont.

| sample | Gene Break-point 5p | Gene Break-point 3p | Frame Type | SEQ ID NO: | Fused Sequence |
|---|---|---|---|---|---|
| | | | | | CTGTGACTTCGTTAAGCTCCGAGATATGCTTCTTTGTAC CAATATGGAAAATCTAAAAGAAAAAACCCACACTCAG CACTATGAATGTTATAGGTACCAAAAACTGCAGAAAAT GGGCTTTACAGATGTGGGTCCAAACAACCAGCCAGTT AGTTTTCAAGAAATCTTTGAAGCCAAAAGACAAGAGTT CTATGATCAATGTCAGAGGGAAGAAGAAGAGTTGAAA CAGAGATTTATGCAGCGAGTCAAGGAGAAAGAAGCAA CATTTAAAGAAGCTGAAAAAGAGCTGCAGGACAAGTT CGAGCATCTTAAAATGATTCAACAGGAGGAGATAAGG AAGCTCGAGGAAGAGAAAAAACAACTGGAAGGAGAA ATCATAGATTTTTATAAAATGAAAGCTGCCTCCGAAGC ACTGCAGACTCAGCTGAGCACCGATACAAAGAAAGAC AAACATCGTAAGAAA |
| G17512. TCGA-27-1837-01A-01R-1850-01.2 | 55268106 | 55863785 | InFrame | 8281 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA AATCATCTGTGCCCAGCAGTGCTCCGGGCGCTGCCGTG GCAAGTCCCCCAGTGACTGCTGCCACAACCAGTGTGCT GCAGGCTGCACAGGCCCCCGGGAGAGCGACTGCCTG GTCTGCCGCAAATTCCGAGACGAAGCCACGTGCAAGG ACACCTGCCCCCCACTCATGCTCTACAACCCCACCACGT ACCAGATGGATGTGAACCCCGAGGGCAAATACAGCTT TGGTGCCACCTGCGTGAAGAAGTGTCCCCGTAATTATG TGGTGACAGATCACGGCTCGTGCGTCCGAGCCTGTGG GGCCGACAGCTATGAGATGGAGGAAGACGGCGTCCG CAAGTGTAAGAAGTGCGAAGGGCCTTGCCGCAAAGTG TGTAACGGAATAGGTATTGGTGAATTTAAAGACTCACT CTCCATAAATGCTACGAATATTAAACACTTCAAAAACT GCACCTCCATCAGTGGCGATCTCCACATCCTGCCGGTG GCATTTAGGGGTGACTCCTTCACACATACTCCTCCTCTG GATCCACAGGAACTGGATATTCTGAAAACCGTAAAGG AAATCACAGGGTTTTTGCTGATTCAGGCTTGGCCTGAA AACAGGACGGACCTCCATGCCTTTGAGAACCTAGAAA TCATACGCGGCAGGACCAAGCAACATGGTCAGTTTTCT CTTGCAGTCGTCAGCCTGAACATAACATCCTTGGGATT ACGCTCCCTCAAGGAGATAAGTGATGGAGATGTGATA ATTTCAGGAAACAAAAATTTGTGCTATGCAAATACAAT AAACTGGAAAAAACTGTTTGGGACCTCCGGTCAGAAA ACCAAAATTATAAGCAACAGAGGTGAAAACAGCTGCA AGGCCACAGGCCAGGTCTGCCATGCCTTGTGCTCCCCC GAGGGCTGCTGGGGCCCGGAGCCCAGGGACTGCGTC |

| sample | Gene Break-point 5p | Gene Break-point 3p | Frame Type | SEQ ID NO: | Fused Sequence |
|---|---|---|---|---|---|
| | | | | | TCTTGCCGGAATGTCAGCCGAGGCAGGGAATGCGTGG ACAAGTGCAACCTTCTGGAGGGTGAGCCAAGGGAGTT TGTGGAGAACTCTGAGTGCATACAGTGCCACCCAGAG TGCCTGCCTCAGGCCATGAACATCACCTGCACAGGACG GGGACCAGACAACTGTATCCAGTGTGCCCACTACATTG ACGGCCCCCACTGCGTCAAGACCTGCCCGGCAGGAGT CATGGGAGAAAACAACACCCTGGTCTGGAAGTACGCA GACGCCGGCCATGTGTGCCACCTGTGCCATCCAAACTG CACCTACGGATGCACTGGGCCAGGTCTTGAAGGCTGT CCAACGAATGGGCCTAAGATCCCGTCCATCGCCACTGG GATGGTGGGGCCCTCCTCTTGCTGCTGGTGGTGGCC CTGGGGATCGGCCTCTTCATGCGAAGGCGCCACATCG TTCGGAAGCGCACGCTGCGGAGGCTGCTGCAGGAGA GGGAGCTTGTGGAGCCTCTTACACCCAGTGGAGAAGC TCCCAACCAAGCTCTCTTGAGGATCTTGAAGGAAACTG AATTCAAAAAGATCAAAGTGCTGGGCTCCGGTGCGTT CGGCACGGTGTATAAGGGACTCTGGATCCCAGAAGGT GAGAAAGTTAAAATTCCCGTCGCTATCAAGGAATTAA GAGAAGCAACATCTCCGAAAGCCAACAAGGAAATCCT CGATGAAGCCTACGTGATGGCCAGCGTGGACAACCCC CACGTGTGCCGCCTGCTGGGCATCTGCCTCACCTCCAC CGTGCAGCTCATCACGCAGCTCATGCCCTTCGGCTGCC TCCTGGACTATGTCCGGGAACACAAAGACAATATTGG CTCCCAGTACCTGCTCAACTGGTGTGTGCAGATCGCAA AGGGCATGAACTACTTGGAGGACCGTCGCTTGGTGCA CCGCGACCTGGCAGCCAGGAACGTACTGGTGAAAACA CCGCAGCATGTCAAGATCACAGATTTTGGGCTGGCCA AACTGCTGGGTGCGGAAGAGAAAGAATACCATGCAG AAGGAGGCAAAGTGCCTATCAAGTGGATGGCATTGGA ATCAATTTTACACAGAATCTATACCCACCAGAGTGATG TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|CTGCAG GACAAGTTCGAGCATCTTAAAATGATTCAACAGGAGG AGATAAGGAAGCTCGAGGAAGAGAAAAAACAACTGG AAGGAGAAATCATAGATTTTTATAAAATGAAAGCTGCC TCCGAAGCACTGCAGACTCAGCTGAGCACCGATACAA AGAAAGACAAACATCGTAAGAAA |
| NYU_A | 1808661 | 1737458 | InFrame | 8282 | ATGGGCGCCCCTGCCTGCGCCCTCGCGCTCTGCGTGGC CGTGGCCATCGTGGCCGGCGCCTCCTCGGAGTCCTTG GGGACGGAGCAGCGCGTCGTGGGGCGAGCGGCAGAA GTCCCGGGCCCAGAGCCCGGCCAGCAGGAGCAGTTG GTCTTCGGCAGCGGGGATGCTGTGGAGCTGAGCTGTC CCCCGCCCGGGGGTGGTCCCATGGGGCCCACTGTCTG GGTCAAGGATGGCACAGGGCTGGTGCCCTCGGAGCGT GTCCTGGTGGGGCCCCAGCGGCTGCAGGTGCTGAATG CCTCCCACGAGGACTCCGGGGCCTACAGCTGCCGGCA GCGGCTCACGCAGCGCGTACTGTGCCACTTCAGTGTGC GGGTGACAGACGCTCCATCCTCGGGAGATGACGAAGA CGGGGAGGACGAGGCTGAGGACACAGGTGTGGACAC AGGGGCCCCTTACTGGACACGGCCCGAGCGGATGGAC |

FIG. 27 Cont.

| sample | Gene Break-point 5p | Gene Break-point 3p | Frame Type | SEQ ID NO: | Fused Sequence |
|---|---|---|---|---|---|
| | | | | | AAGAAGCTGCTGGCCGTGCCGGCCGCCAACACCGTCC GCTTCCGCTGCCCAGCCGCTGGCAACCCCACTCCCTCC ATCTCCTGGCTGAAGAACGGCAGGGAGTTCCGCGGCG AGCACCGCATTGGAGGCATCAAGCTGCGGCATCAGCA GTGGAGCCTGGTCATGGAAAGCGTGGTGCCCTCGGAC CGCGGCAACTACACCTGCGTCGTGGAGAACAAGTTTG GCAGCATCCGGCAGACGTACACGCTGGACGTGCTGGA GCGCTCCCCGCACCGGCCCATCCTGCAGGCGGGGCTG CCGGCCAACCAGACGGCGGTGCTGGGCAGCGACGTG GAGTTCCACTGCAAGGTGTACAGTGACGCACAGCCCC ACATCCAGTGGCTCAAGCACGTGGAGGTGAATGGCAG CAAGGTGGGCCCGGACGGCACACCCTACGTTACCGTG CTCAAGTCCTGGATCAGTGAGAGTGTGGAGGCCGACG TGCGCCTCCGCCTGGCCAATGTGTCGGAGCGGGACGG GGGCGAGTACCTCTGTCGAGCCACCAATTTCATAGGC GTGGCCGAGAAGGCCTTTTGGCTGAGCGTTCACGGGC CCCGAGCAGCCGAGGAGGAGCTGGTGGAGGCTGACG AGGCGGGCAGTGTGTATGCAGGCATCCTCAGCTACGG GGTGGGCTTCTTCCTGTTCATCCTGGTGGTGGCGGCTG TGACGCTCTGCCGCCTGCGCAGCCCCCCCAAGAAAGG CCTGGGCTCCCCCACCGTGCACAAGATCTCCCGCTTCC CGCTCAAGCGACAGGTGTCCCTGGAGTCCAACGCGTC CATGAGCTCCAACACACCACTGGTGCGCATCGCAAGG CTGTCCTCAGGGGAGGGCCCCACGCTGGCCAATGTCT CCGAGCTCGAGCTGCCTGCCGACCCCAAATGGGAGCT GTCTCGGGCCCGGCTGACCCTGGGCAAGCCCCTTGGG GAGGGCTGCTTCGGCCAGGTGGTCATGGCGGAGGCC ATCGGCATTGACAAGGACCGGGCCGCCAAGCCTGTCA CCGTAGCCGTGAAGATGCTGAAAGACGATGCCACTGA CAAGGACCTGTCCGGACCTGGTGTCTGAGATGGAGATG ATGAAGATGATCGGGAAACACAAAAACATCATCAACC TGCTGGGCGCCTGCACGCAGGGCGGGCCCCTGTACGT GCTGGTGGAGTACGCGGCCAAGGGTAACCTGCGGGA GTTTCTgcgggcgcggcggcccccgggccTGGACTACTCCTTC GACACCTGCAAGCCGCCCGAGGAGCAGCTCACCTTCA AGGACCTGGTGTCCTGTGCCTACCAGGTGGCCCGGGG CATGGAGTACTTGGCCTCCCAGAAGTGCATCCACAGG GACCTGGCTGCCCGCAATGTGCTGGTGACCGAGGACA ACGTGATGAAGATCGCAGACTTCGGGCTGGCCCGGGA CGTGCACAACCTCGACTACTACAAGAAGACGACCAAC GGCCGGCTGCCCGTGAAGTGGATGGCGCCTGAGGCCT TGTTTGACCGAGTCTACACTCACCAGAGTGACGTCTGG TCCTTTGGGGTCCTGCTCTGGGAGATCTTCACGCTGGG GGGCTCCCCGTACCCCGGCATCCCTGTGGAGGAGCTCT TCAAGCTGCTGAAGGAGGGCCACCGCATGGACAAGCC CGCCAACTGCACACACGACCTGTACATGATCATGCGG GAGTGCTGGCATGCCGCGCCCTCCCAGAGGCCCACCTT CAAGCAGCTGGTGGAGGACCTGGACCGTGTCCTTACC GTGACGTCCACCGAC\|TTTAAGGAGTCGGCCTTGAGG AAGCAGTCCTTATACCTCAAGTTCGACCCCCTCCTGAG GACAGTCCTGGTAGACCAGTGCCCGTGGCCACCGAG ACCAGCAGCATGCACGGTGCAAATGAGACTCCCTCAG GACGTCCGCGGGAAGCCAAGCTTGTGGAGTTCGATTT CTTGGGAGCACTGGACATTCCTGTGCCAGGCCCACCCC CAGGTGTTCCCGCGCCTGGGGGCCCACCCCTGTCCACC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GGACCTATAGTGGACCTGCTCCAGTACAGCCAGAAGG<br>ACCTGGATGCAGTGGTAAAGGCGACACAGGAGGAGA<br>ACCGGGAGCTGAGGAGCAGGTGTGAGGAGCTCCACG<br>GGAAGAACCTGGAACTGGGGAAGATCATGGACAGGT<br>TCGAAGAGGTTGTGTACCAGGCCATGGAGGAAGTTCA<br>GAAGCAGAAGGAACTTTCCAAAGCTGAAATCCAGAAA<br>GTTCTAAAAGAAAAAGACCAACTTACCACAGATCTGAA<br>CTCCATGGAGAAGTCCTTCTCCGACCTCTTCAAGCGTTT<br>TGAGAAACAGAAAGAGGTGATCGAGGGCTACCGCAA<br>GAACGAAGAGTCACTGAAGAAGTGCGTGGAGGATTA<br>CCTGGCAAGGATCACCCAGGAGGGCCAGAGGTACCAA<br>GCCCTGAAGGCCCACGCGGAGGAGAAGCTGCAGCTG<br>GCAAACGAGGAGATCGCCCAGGTCCGGAGCAAGGCC<br>CAGGCGGAAGCGTTGGCCCTCCAGGCCAGCCTGAGGA<br>AGGAGCAGATGCGCATCCAGTCGCTGGAGAAGACAGT<br>GGAGCAGAAGACTAAAGAGAACGAGGAGCTGACCAG<br>GATCTGCGACGACCTCATCTCCAAGATGGAGAAGATC |
| G17814.<br>TCGA-06-<br>5411-<br>01A-01R-<br>1849-<br>01.4 | 204951148 | 156844363 | InFrame | 8283 | ATGGCCAGGCAGCCACCGCCGCCCTGGGTCCATGCAG<br>CCTTCCTCCTCTGCCTCCTCAGTCTTGGCGGAGCCATCG<br>AAATTCCTATGGATCTGACGCAGCCGCCAACCATCACC<br>AAGCAGTCAGCGAAGGATCACATCGTGGACCCCCGTG<br>ATAACATCCTGATTGAGTGTGAAGCAAAAGGGAACCC<br>TGCCCCCAGCTTCCACTGGACACGAAACAGCAGATTCT<br>TCAACATCGCCAAGGACCCCCGGGTGTCCATGAGGAG<br>GAGGTCTGGGACCCTGGTGATTGACTTCCGCAGTGGC<br>GGGCGGCCGGAGGAATATGAGGGGGAATATCAGTGC<br>TTCGCCCGCAACAAATTTGGCACGGCCCTGTCCAATAG<br>GATCCGCCTGCAGGTGTCTAAATCTCCTCTGTGGCCCA<br>AGGAAAAACCTAGACCCTGTCGTGGTCCAAGAGGGCGC<br>TCCTTTGACGCTCCAGTGCAACCCCCCGCCTGGACTTCC<br>ATCCCCGGTCATCTTCTGGATGAGCAGCTCCATGGAGC<br>CCATCACCCAAGACAAACGTGTCTCTCAGGGCCATAAC<br>GGAGACCTATACTTCTCCAACGTGATGCTGCAGGACAT<br>GCAGACCGACTACAGTTGTAACGCCCGCTTCCACTTCA<br>CCCACACCATCCAGCAGAAGAACCCTTTCACCCTCAAG<br>GTCCTCACCAACCACCCTTATAATGACTCGTCCTTAAGA<br>AACCACCCTGACATGTACAGTGCCCGAGGAGTTGCAG<br>AAAGAACACCAAGCTTCATGTATCCCCAGGGCACCGC<br>GAGCAGCCAGATGGTGCTTCGTGGCATGGACCTCCTG<br>CTGGAATGCATCGCCTCCGGGGTCCCAACACCAGACAT<br>CGCATGGTACAAGAAAGGTGGGGACCTCCCATCTGAT<br>AAGGCCAAGTTTGAGAACTTTAATAAGGCCCTGCGTAT<br>CACAAATGTCTCTGAGGAAGACTCCGGGGAGTATTTCT<br>GCCTGGCCTCCAACAAGATGGGCAGCATCCGGCACAC<br>GATCTCGGTGAGAGTAAAGGCTGCTCCCTACTGGCTG<br>GACGAACCCAAGAACCTTATTCTGGCTCCTGGCGAGG<br>ATGGGAGACTGGTGTGTCGAGCCAATGGAAACCCCAA<br>ACCCACTGTCCAGTGGATGGTGAATGGGGAACCTTTG<br>CAATCGGCACCACCTAACCCAAACCGTGAGGTGGCCG<br>GAGACACCATCATCTTCCGGGACACCCAGATCAGCAG<br>CAGGGCTGTGTACCAGTGCAACACCTCCAACGAGCAT<br>GGCTACCTGCTGGCCAACGCCTTTGTCAGTGTGCTGGA<br>TGTGCCGCCTCGGATGCTGTCGCCCCGGAACCAGCTCA<br>TTCGAGTGATTCTTTACAACCGGACGCGGCTGGACTGC<br>CCTTTCTTTGGGTCTCCCATCCCCACACTGCGATGGTTT |

| sample | Gene Break-point 5p | Gene Break-point 3p | Frame Type | SEQ ID NO: | Fused Sequence |
|---|---|---|---|---|---|
| | | | | | AAGAATGGGCAAGGAAGCAACCTGGATGGTGGCAAC<br>TACCATGTTTATGAGAACGGCAGTCTGGAAATTAAGAT<br>GATCCGCAAAGAGGACCAGGGCATCTACACCTGTGTC<br>GCCACCAACATCCTGGGCAAAGCTGAAAACCAAGTCC<br>GCCTGGAGGTCAAAGACCCCACCAGGATCTACCGGAT<br>GCCCGAGGACCAGGTGGCCAGAAGGGGCACCACGGT<br>GCAGCTGGAGTGTCGGGTGAAGCACGACCCCTCCCTG<br>AAACTCACCGTCTCCTGGCTGAAGGATGACGAGCCGC<br>TCTATATTGGAAACAGGATGAAGAAGGAAGACGACTC<br>CCTGACCATCTTTGGGGTGGCAGAGCGGGACCAGGGC<br>AGTTACACGTGTGTCGCCAGCACCGAGCTAGACCAAG<br>ACCTGGCCAAGGCCTACCTCACCGTGCTAGCTGATCAG<br>GCCACTCCAACTAACCGTTTGGCTGCCCTGCCCAAAGG<br>ACGGCCAGACCGGCCCCGGGACCTGGAGCTGACCGAC<br>CTGGCCGAGAGGAGCGTGCGGCTGACCTGGATCCCCG<br>GGGATGCTAACAACAGCCCCATCACAGACTACGTCGTC<br>CAGTTTGAAGAAGACCAGTTCCAACCTGGGGTCTGGC<br>ATGACCATTCCAAGTACCCCGGCAGCGTTAACTCAGCC<br>GTCCTCCGGCTGTCCCCGTATGTCAACTACCAGTTCCGT<br>GTCATTGCCATCAACGAGGTTGGGAGCAGCCACCCCA<br>GCCTCCCATCCGAGCGCTACCGAACCAGTGGAGCACC<br>CCCCGAGTCCAATCCTGGTGACGTGAAGGGAGAGGG<br>GACCAGAAAGAACAACATGGAGATCACGTGGACGCCC<br>ATGAATGCCACCTCGGCCTTTGGCCCCAACCTGCGCTA<br>CATTGTCAAGTGGAGGCGGAGAGAGACTCGAGAGGC<br>CTGGAACAACGTCACAGTGTGGGGCTCTCGCTACGTG<br>GTGGGGCAGACCCCAGTCTACGTGCCCTATGAGATCC<br>GAGTCCAGGCTGAAAATGACTTCGGGAAGGGCCCTGA<br>GCCAGAGTCCGTCATCGGTTACTCCGGAGAAGATT\|AC<br>ACTAACAGCACATCTGGAGACCCGGTGGAGAAGAAG<br>GACGAAACACCTTTTGGGGTCTCGGTGGCTGTGGGCC<br>TGGCCGTCTTTGCCTGCCTCTTCCTTTCTACGCTGCTCC<br>TTGTGCTCAACAAATGTGGACGGAGAAACAAGTTTGG<br>GATCAACCGCCCGGCTGTGCTGGCTCCAGAGGATGGG<br>CTGGCCATGTCCCTGCATTTCATGACATTGGGTGGCAG<br>CTCCCTGTCCCCCACCGAGGGCAAAGGCTCTGGGCTCC<br>AAGGCCACATCATCGAGAACCCACAATACTTCAGTGAT<br>GCCTGTGTTCACCACATCAAGCGCCGGGACATCGTGCT<br>CAAGTGGGAGCTGGGGGAGGGCGCCTTTGGGAAGGT<br>CTTCCTTGCTGAGTGCCACAACCTCCTGCCTGAGCAGG<br>ACAAGATGCTGGTGGCTGTCAAGGCACTGAAGGAGGC<br>GTCCGAGAGTGCTCGGCAGGACTTCCAGCGTGAGGCT<br>GAGCTGCTCACCATGCTGCAGCACCAGCACATCGTGC<br>GCTTCTTCGGCGTCTGCACCGAGGGCCGCCCCCTGCTC<br>ATGGTCTTTGAGTATATGCGGCACGGGGACCTCAACC<br>GCTTCCTCCGATCCCATGGACCTGATGCCAAGCTGCTG<br>GCTGGTGGGAGGATGTGGCTCCAGGCCCCTGGGTC<br>TGGGGCAGCTGCTGGCCGTGGCTAGCCAGGTCGCTGC<br>GGGGATGGTGTACCTGGCGGGTCTGCATTTTGTGCAC<br>CGGGACCTGGCCACACGCAACTGTCTAGTGGGCCAGG<br>GACTGGTGGTCAAGATTGGTGATTTTGGCATGAGCAG<br>GGATATCTACAGCACCGACTATTACCGTGTGGGAGGC<br>CGCACCATGCTGCCCATTCGCTGGATGCCGCCCGAGA<br>GCATCCTGTACCGTAAGTTCACCACCGAGAGCGACGT<br>GTGGAGCTTCGGCGTGGTGCTCTGGGAGATCTTCACC |

FIG. 27 Cont.

| sample | Gene Break-point 5p | Gene Break-point 3p | Frame Type | SEQ ID NO: | Fused Sequence |
|---|---|---|---|---|---|
| | | | | | TACGGCAAGCAGCCCTGGTACCAGCTCTCCAACACGG AGGCAATCGACTGCATCACGCAGGGACGTGAGTTGGA GCGGCCACGTGCCTGCCCACCAGAGGTCTACGCCATC ATGCGGGGCTGCTGGCAGCGGGAGCCCCAGCAACGC CACAGCATCAAGGATGTGCACGCCCGGCTGCAAGCCC TGGCCCAGGCACCTCCTGTCTACCTGGATGTCCTGGGC |
| G17223. TCGA-06-0750-01A-01R-1849-01.2 | 55268106 | 55863785 | InFrame | 8284 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA AATCATCTGTGCCCAGCAGTGCTCCGGGCGCTGCCGTG GCAAGTCCCCAGTGACTGCTGCCACAACCAGTGTGCT GCAGGCTGCACAGGCCCCCGGGAGAGCGACTGCCTG GTCTGCCGCAAATTCCGAGACGAAGCCACGTGCAAGG ACACCTGCCCCCCACTCATGCTCTACAACCCCACCACGT ACCAGATGGATGTGAACCCCGAGGGCAAATACAGCTT TGGTGCCACCTGCGTGAAGAAGTGTCCCCGTAATTATG TGGTGACAGATCACGGCTCGTGCGTCCGAGCCTGTGG GGCCGACAGCTATGAGATGGAGGAAGACGGCGTCCG CAAGTGTAAGAAGTGCGAAGGGCCTTGCCGCAAAGTG TGTAACGGAATAGGTATTGGTGAATTTAAAGACTCACT CTCCATAAATGCTACGAATATTAAACACTTCAAAAACT GCACCTCCATCAGTGGCGATCTCCACATCCTGCCGGTG GCATTTAGGGGTGACTCCTTCACACATACTCCTCCTCTG GATCCACAGGAACTGGATATTCTGAAAACCGTAAAGG AAATCACAGGGTTTTTGCTGATTCAGGCTTGGCCTGAA AACAGGACGGACCTCCATGCCTTTGAGAACCTAGAAA TCATACGCGGCAGGACCAAGCAACATGGTCAGTTTTCT CTTGCAGTCGTCAGCCTGAACATAACATCCTTGGGATT ACGCTCCCTCAAGGAGATAAGTGATGGAGATGTGATA ATTTCAGGAAACAAAAATTTGTGCTATGCAAATACAAT AAACTGGAAAAAACTGTTTGGGACCTCCGGTCAGAAA ACCAAAATTATAAGCAACAGAGGTGAAAACAGCTGCA AGGCCACAGGCCAGGTCTGCCATGCCTTGTGCTCCCCC GAGGGCTGCTGGGGCCCGGAGCCCAGGGACTGCGTC TCTTGCCGGAATGTCAGCCGAGGCAGGGAATGCGTGG ACAAGTGCAACCTTCTGGAGGGTGAGCCAAGGGAGTT TGTGGAGAACTCTGAGTGCATACAGTGCCACCCAGAG TGCCTGCCTCAGGCCATGAACATCACCTGCACAGGACG GGGACCAGACAACTGTATCCAGTGTGCCCACTACATTG ACGGCCCCCACTGCGTCAAGACCTGCCCCGGCAGGAGT CATGGGAGAAAACAACACCCTGGTCTGGAAGTACGCA |

FIG. 27 Cont.

| sample | Gene Break- point 5p | Gene Break- point 3p | Frame Type | SEQ ID NO: | Fused Sequence |
|---|---|---|---|---|---|
| | | | | | GACGCCGGCCATGTGTGCCACCTGTGCCATCCAAACTG CACCTACGGATGCACTGGGCCAGGTCTTGAAGGCTGT CCAACGAATGGGCCTAAGATCCCGTCCATCGCCACTGG GATGGTGGGGGCCCTCCTCTTGCTGCTGGTGGTGGCC CTGGGGATCGGCCTCTTCATGCGAAGGCGCCACATCG TTCGGAAGCGCACGCTGCGGAGGCTGCTGCAGGAGA GGGAGCTTGTGGAGCCTCTTACACCCAGTGGAGAAGC TCCCAACCAAGCTCTCTTGAGGATCTTGAAGGAAACTG AATTCAAAAAGATCAAAGTGCTGGGCTCCGGTGCGTT CGGCACGGTGTATAAGGGACTCTGGATCCCAGAAGGT GAGAAAGTTAAAATTCCCGTCGCTATCAAGGAATTAA GAGAAGCAACATCTCCGAAAGCCAACAAGGAAATCCT CGATGAAGCCTACGTGATGGCCAGCGTGGACAACCCC CACGTGTGCCGCCTGCTGGGCATCTGCCTCACCTCCAC CGTGCAGCTCATCACGCAGCTCATGCCCTTCGGCTGCC TCCTGGACTATGTCCGGGAACACAAAGACAATATTGG CTCCCAGTACCTGCTCAACTGGTGTGTGCAGATCGCAA AGGGCATGAACTACTTGGAGGACCGTCGCTTGGTGCA CCGCGACCTGGCAGCCAGGAACGTACTGGTGAAAACA CCGCAGCATGTCAAGATCACAGATTTTGGGCTGGCCA AACTGCTGGGTGCGGAAGAGAAAGAATACCATGCAG AAGGAGGCAAAGTGCCTATCAAGTGGATGGCATTGGA ATCAATTTTACACAGAATCTATACCCACCAGAGTGATG TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|CTGCAG GACAAGTTCGAGCATCTTAAAATGATTCAACAGGAGG AGATAAGGAAGCTCGAGGAAGAGAAAAAACAACTGG AAGGAGAAATCATAGATTTTTATAAAAATGAAAGCTGCC TCCGAAGCACTGCAGACTCAGCTGAGCACCGATACAA AGAAAGACAAACATCGTAAGAAA |
| G17798. TCGA-32- 5222- 01A-01R- 1850- 01.4 | 55268106 | 55863785 | InFrame | 8285 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA AATCATCTGTGCCCAGCAGTGCTCCGGGCGCTGCCGTG GCAAGTCCCCCAGTGACTGCTGCCACAACCAGTGTGCT GCAGGCTGCACAGGCCCCCGGGAGAGCGACTGCCTG |

FIG. 27 Cont.

| sample | Gene Break-point 5p | Gene Break-point 3p | Frame Type | SEQ ID NO: | Fused Sequence |
|---|---|---|---|---|---|
| | | | | | GTCTGCCGCAAATTCCGAGACGAAGCCACGTGCAAGG<br>ACACCTGCCCCCCACTCATGCTCTACAACCCCACCACGT<br>ACCAGATGGATGTGAACCCCGAGGGCAAATACAGCTT<br>TGGTGCCACCTGCGTGAAGAAGTGTCCCCGTAATTATG<br>TGGTGACAGATCACGGCTCGTGCGTCCGAGCCTGTGG<br>GGCCGACAGCTATGAGATGGAGGAAGACGGCGTCCG<br>CAAGTGTAAGAAGTGCGAAGGGCCTTGCCGCAAAGTG<br>TGTAACGGAATAGGTATTGGTGAATTTAAAGACTCACT<br>CTCCATAAATGCTACGAATATTAAACACTTCAAAAACT<br>GCACCTCCATCAGTGGCGATCTCCACATCCTGCCGGTG<br>GCATTTAGGGGTGACTCCTTCACACATACTCCTCCTCTG<br>GATCCACAGGAACTGGATATTCTGAAAACCGTAAAGG<br>AAATCACAGGGTTTTTGCTGATTCAGGCTTGGCCTGAA<br>AACAGGACGGACCTCCATGCCTTTGAGAACCTAGAAA<br>TCATACGCGGCAGGACCAAGCAACATGGTCAGTTTTCT<br>CTTGCAGTCGTCAGCCTGAACATAACATCCTTGGGATT<br>ACGCTCCCTCAAGGAGATAAGTGATGGAGATGTGATA<br>ATTTCAGGAAACAAAAATTTGTGCTATGCAAATACAAT<br>AAACTGGAAAAAACTGTTTGGGACCTCCGGTCAGAAA<br>ACCAAAATTATAAGCAACAGAGGTGAAAACAGCTGCA<br>AGGCCACAGGCCAGGTCTGCCATGCCTTGTGCTCCCCC<br>GAGGGCTGCTGGGGCCCGGAGCCCAGGGACTGCGTC<br>TCTTGCCGGAATGTCAGCCGAGGCAGGGAATGCGTGG<br>ACAAGTGCAACCTTCTGGAGGGTGAGCCAAGGGAGTT<br>TGTGGAGAACTCTGAGTGCATACAGTGCCACCCAGAG<br>TGCCTGCCTCAGGCCATGAACATCACCTGCACAGGACG<br>GGGACCAGACAACTGTATCCAGTGTGCCCACTACATTG<br>ACGGCCCCCACTGCGTCAAGACCTGCCCGGCAGGAGT<br>CATGGGAGAAAACAACACCCTGGTCTGGAAGTACGCA<br>GACGCCGGCCATGTGTGCCACCTGTGCCATCCAAACTG<br>CACCTACGGATGCACTGGGCCAGGTCTTGAAGGCTGT<br>CCAACGAATGGGCCTAAGATCCCGTCCATCGCCACTGG<br>GATGGTGGGGCCCTCCTCTTGCTGCTGGTGGTGGCC<br>CTGGGGATCGGCCTCTTCATGCGAAGGCGCCACATCG<br>TTCGGAAGCGCACGCTGCGGAGGCTGCTGCAGGAGA<br>GGGAGCTTGTGGAGCCTCTTACACCCAGTGGAGAAGC<br>TCCCAACCAAGCTCTCTTGAGGATCTTGAAGGAAACTG<br>AATTCAAAAAGATCAAAGTGCTGGGCTCCGGTGCGTT<br>CGGCACGGTGTATAAGGGACTCTGGATCCCAGAAGGT<br>GAGAAAGTTAAAATTCCCGTCGCTATCAAGGAATTAA<br>GAGAAGCAACATCTCCGAAAGCCAACAAGGAAATCCT<br>CGATGAAGCCTACGTGATGGCCAGCGTGGACAACCCC<br>CACGTGTGCCGCCTGCTGGGCATCTGCCTCACCTCCAC<br>CGTGCAGCTCATCACGCAGCTCATGCCCTTCGGCTGCC<br>TCCTGGACTATGTCCGGGAACACAAAGACAATATTGG<br>CTCCCAGTACCTGCTCAACTGGTGTGTGCAGATCGCAA<br>AGGGCATGAACTACTTGGAGGACCGTCGCTTGGTGCA<br>CCGCGACCTGGCAGCCAGGAACGTACTGGTGAAAACA<br>CCGCAGCATGTCAAGATCACAGATTTTGGGCTGGCCA<br>AACTGCTGGGTGCGGAAGAGAAAGAATACCATGCAG<br>AAGGAGGCAAAGTGCCTATCAAGTGGATGGCATTGGA<br>ATCAATTTTACACAGAATCTATACCCACCAGAGTGATG<br>TCTGGAGCTACGGGGTGACTGTTTGGGAGTTGATGAC<br>CTTTGGATCCAAGCCATATGACGGAATCCCTGCCAGCG<br>AGATCTCCTCCATCCTGGAGAAAGGAGAACGCCTCCCT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|CTGCAG GACAAGTTCGAGCATCTTAAAATGATTCAACAGGAGG AGATAAGGAAGCTCGAGGAAGAGAAAAAACAACTGG AAGGAGAAATCATAGATTTTTATAAAATGAAAGCTGCC TCCGAAGCACTGCAGACTCAGCTGAGCACCGATACAA AGAAAGACAAACATCGTAAGAAA |
| G17195. TCGA-06-0138-01A-02R-1849-01.2 | 89764755 | 58339411 | InFrame | 8286 | ATGTTCAAGAGAATGGCCGAATTTGGGCCTGACTCCG GCGGGAGAGTAAAGGGTGTTACTATCGTTAAACCAAT AGTTTACGGTAATGTTGCTCGGTATTTTGGAAAGAAAA GAGAAGAAGATGGGCACACTCATCAGTGGACAGTATA TGTGAAACCATATAGAAATGAGGATATGTCAGCATAT GTGAAGAAAATCCAGTTTAAATTACATGAAAGCTATG GCAATCCTTTAAGAGTTGTTACTAAACCTCCATATGAA ATTACTGAAACAGGATGGGGTGAATTCGAAATAATCA TCAAAATATTTTTCATTGACCCTAATGAAAGACCTGTAA CCCTGTATCATTTGCTAAAGCTGTTTCAATCAGACACCA ATGCAATGCTGGGGAAAAAGACAGTGGTTTCAGAGTT CTATGATGAAATGATATTTCAAGACCCAACAGCAATGA TGCAACAATTATTGACAACATCTCGTCAGCTAACATTA GGAGCCTATAAGCATGAAACAGAAT\|ATCCATATGTCA AACTTCTGCTTGATGCTATGAAACACTCAGGTTGTGCT GTTAACAAAGATAGACACTTTTCTTGCGAAGACTGTAA TGGAAATGTCAGTGGAGGTTTTGATGCTTCAACATCTC AGATAGTTTTGTGCCAGAATAATATCCATAATCAGGCC CATATGAACAGAGTGGTCACACACGAGCTTATTCATGC ATTTGATCATTGTCGTGCCCATGTCGACTGGTTCACCA ACATCAGACATTTGGCGTGCTCAGAGGTTCGAGCTGCT AACCTTAGTGGAGACTGCTCACTTGTCAATGAAATATT CAGGTTACATTTTGGATTAAAACAACACCACCAGACTT GTGTGCGAGACAGAGCCACTCTTTCTATCCTGGCTGTT AGGAATATCAGCAAAGAAGTAGCTAAAAAGGCTGTTG ATGAAGTTTTTGAATCTTGTTTCAATGACCATGAACCTT TTGGAAGGATCCCACATAACAAGACTTATGCAAGATAT GCTCACAGAGACTTTGAAAACCGTGATCGGTATTATTC AAATATA |
| G17803. TCGA-76-4925-01A-01R-1850-01.4 | 1808661 | 1739325 | InFrame | 8287 | ATGGGCGCGCCCCTGCCTGCGCCCTCGCGCTCTGCGTGGC CGTGGCCATCGTGGCCGGCGCCTCCTCGGAGTCCTTG GGGACGGAGCAGCGCGTCGTGGGGCGAGCGGCAGAA GTCCCGGGCCCAGAGCCCGGCCAGCAGGAGCAGTTG GTCTTCGGCAGCGGGGATGCTGTGGAGCTGAGCTGTC CCCGCCCGGGGGTGGTCCCATGGGGCCCACTGTCTG GGTCAAGGATGGCACAGGGCTGGTGCCCTCGGAGCGT GTCCTGGTGGGGCCCCAGCGGCTGCAGGTGCTGAATG CCTCCCACGAGGACTCCGGGGCCTACAGCTGCCGGCA GCGGCTCACGCAGCGCGTACTGTGCCACTTCAGTGTGC GGGTGACAGACGCTCCATCCTCGGGAGATGACGAAGA CGGGGAGGACGAGGCTGAGGACACAGGTGTGGACAC AGGGGCCCCTTACTGGACACGGCCCGAGCGGATGGAC AAGAAGCTGCTGGCCGTGCCGGCCGCCAACACCGTCC GCTTCCGCTGCCCAGCCGCTGGCAACCCCACTCCCTCC ATCTCCTGGCTGAAGAACGGCAGGGAGTTCCGCGGCG AGCACCGCATTGGAGGCATCAAGCTGCGGCATCAGCA |

FIG. 27 Cont.

| sample | Gene Break point 5p | Gene Break point 3p | Frame Type | SEQ ID NO: | Fused Sequence |
|---|---|---|---|---|---|
| | | | | | GTGGAGCCTGGTCATGGAAAGCGTGGTGCCCTCGGAC CGCGGCAACTACACCTGCGTCGTGGAGAACAAGTTTG GCAGCATCCGGCAGACGTACACGCTGGACGTGCTGGA GCGCTCCCCGCACCGGCCCATCCTGCAGGCGGGGCTG CCGGCCAACCAGACGGCGGTGCTGGGCAGCGACGTG GAGTTCCACTGCAAGGTGTACAGTGACGCACAGCCCC ACATCCAGTGGCTCAAGCACGTGGAGGTGAATGGCAG CAAGGTGGGCCCGGACGGCACACCCTACGTTACCGTG CTCAAGTCCTGGATCAGTGAGAGTGTGGAGGCCGACG TGCGCCTCCGCCTGGCCAATGTGTCGGAGCGGGACGG GGGCGAGTACCTCTGTCGAGCCACCAATTTCATAGGC GTGGCCGAGAAGGCCTTTTGGCTGAGCGTTCACGGGC CCCGAGCAGCCGAGGAGGAGCTGGTGGAGGCTGACG AGGCGGGCAGTGTGTATGCAGGCATCCTCAGCTACGG GGTGGGCTTCTTCCTGTTCATCCTGGTGGTGGCGGCTG TGACGCTCTGCCGCCTGCGCAGCCCCCCCAAGAAAGG CCTGGGCTCCCCCACCGTGCACAAGATCTCCCGCTTCC CGCTCAAGCGACAGGTGTCCCTGGAGTCCAACGCGTC CATGAGCTCCAACACACCACTGGTGCGCATCGCAAGG CTGTCCTCAGGGGAGGGCCCCACGCTGGCCAATGTCT CCGAGCTCGAGCTGCCTGCCGACCCCAAATGGGAGCT GTCTCGGGCCCGGCTGACCCTGGGCAAGCCCCTTGGG GAGGGCTGCTTCGGCCAGGTGGTCATGGCGGAGGCC ATCGGCATTGACAAGGACCGGGCCGCCAAGCCTGTCA CCGTAGCCGTGAAGATGCTGAAAGACGATGCCACTGA CAAGGACCTGTCGGACCTGGTGTCTGAGATGGAGATG ATGAAGATGATCGGGAAACACAAAAACATCATCAACC TGCTGGGCGCCTGCACGCAGGGCGGGCCCCTGTACGT GCTGGTGGAGTACGCGGCCAAGGGTAACCTGCGGGA GTTTCTgcgggcgcggcggccccgggccTGGACTACTCCTTC GACACCTGCAAGCCGCCCGAGGAGCAGCTCACCTTCA AGGACCTGGTGTCCTGTGCCTACCAGGTGGCCGGGG CATGGAGTACTTGGCCTCCCAGAAGTGCATCCACAGG GACCTGGCTGCCCGCAATGTGCTGGTGACCGAGGACA ACGTGATGAAGATCGCAGACTTCGGGCTGGCCCGGGA CGTGCACAACCTCGACTACTACAAGAAGACGACCAAC GGCCGGCTGCCCGTGAAGTGGATGGCGCCTGAGGCCT TGTTTGACCGAGTCTACACTCACCAGAGTGACGTCTGG TCCTTTGGGGTCCTGCTCTGGGAGATCTTCACGCTGGG GGGCTCCCCGTACCCCGGCATCCCTGTGGAGGAGCTCT TCAAGCTGCTGAAGGAGGGCCACCGCATGGACAAGCC CGCCAACTGCACACACGACCTGTACATGATCATGCGG GAGTGCTGGCATGCCGCGCCCTCCCAGAGGCCCACCTT CAAGCAGCTGGTGGAGGACCTGGACCGTGTCCTTACC GTGACGTCCACCGAC\|GTGCCAGGCCCACCCCCAGGT GTTCCCGCGCCTGGGGGCCCACCCCTGTCCACCGGACC TATAGTGGACCTGCTCCAGTACAGCCAGAAGGACCTG GATGCAGTGGTAAAGGCGACACAGGAGGAGAACCGG GAGCTGAGGAGCAGGTGTGAGGAGCTCCACGGGAAG AACCTGGAACTGGGGAAGATCATGGACAGGTTCGAAG AGGTTGTGTACCAGGCCATGGAGGAAGTTCAGAAGCA GAAGGAACTTTCCAAAGCTGAAATCCAGAAAGTTCTA AAAGAAAAAGACCAACTTACCACAGATCTGAACTCCAT GGAGAAGTCCTTCTCCGACCTCTTCAAGCGTTTTGAGA AACAGAAAGAGGTGATCGAGGGCTACCGCAAGAACG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | AAGAGTCACTGAAGAAGTGCGTGGAGGATTACCTGGC AAGGATCACCCAGGAGGGCCAGAGGTACCAAGCCCTG AAGGCCCACGCGGAGGAGAAGCTGCAGCTGGCAAAC GAGGAGATCGCCCAGGTCCGGAGCAAGGCCCAGGCG GAAGCGTTGGCCCTCCAGGCCAGCCTGAGGAAGGAGC AGATGCGCATCCAGTCGCTGGAGAAGACAGTGGAGCA GAAGACTAAAGAGAACGAGGAGCTGACCAGGATCTG CGACGACCTCATCTCCAAGATGGAGAAGATC |
| NYU_B | 7388176 | 7604059 | InFrame | 8288 | ATGCACGGGGGTGGCCCCCCCCTCGGGGGACAGCGCAT GCCCGCTGCGCACCATCAAGAGAGTCCAGTTCGGAGT CCTGAGTCCGGATGAACTG\|GTCCCTGTCCTTCGAATG GTGGAAGGTGATACCATCTATGATTACTGCTGGTATTC TCTGATGTCCTCAGCCCAGCCAGACACCTCCTACGTGG CCAGCAGCAGCCGGGAGAACCCGATTCATATCTGGGA CGCATTCACTGGAGAGCTCCGGGCTTCCTTTCGCGCCT ACAACCACCTGGATGAGCTGACGGCAGCCCATTCGCTC TGCTTCTCCCCGGATGGCTCCCAGCTCTTCTGTGGCTTC AACCGGACTGTGCGTGTTTTTTCCACGGCCCGGCCTGG CCGAGACTGCGAGGTCCGAGCCACATTTGCAAAAAAG CAGGGCCAGAGCGGCATCATCTCCTGCATAGCCTTCAG CCCAGCCCAGCCCCTCTATGCCTGTGGCTCCTACGGCC GCTCCCTGGGTCTGTATGCCTGGGATGATGGCTCCCCT CTCGCCTTGCTGGGAGGGCACCAAGGGGGCATCACCC ACCTCTGCTTTCATCCCGATGGCAACCGCTTCTTCTCAG GAGCCCGCAAGGATGCTGAGCTCCTGTGCTGGGATCT CCGGCAGTCTGGTTACCCACTGTGGTCCCTGGGTCGAG AGGTGACCACCAATCAGCGCATCTACTTCGATCTGGAC CCGACCGGGCAGTTCCTAGTGAGTGGCAGCACGAGCG GGGCTGTCTCTGTGTGGGACACGGACGGGCCTGGCAA TGATGGGAAGCCGGAGCCCGTGTTGAGTTTTCTGCCCC AGAAGGACTGCACCAATGGCGTGAGCCTGCACCCTAG CCTGCCTCTCCTGGCCACTGCCTCCGGTCAGCGTGTGT TTCCTGAGCCCACAGAGAGTGGGGACGAAGGAGAGG AGCTGGGCCTTCCCTTGCTCTCCACGCGCCACGTCCAC CTTGAATGTCGGCTTCAGCTCTGGTGGTGTGGGGGGG CGCCAGACTCCAGCATCCCTGATGATCACCAGGGCGA GAAAGGGCAGGGAGGAACGGAGGGAGGTGTGGGTG AGCTGATA |
| G17507. TCGA-28-1747-01C-01R-1850-01.2 | 55268106 | 55863785 | InFrame | 8289 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | AATCATCTGTGCCCAGCAGTGCTCCGGGCGCTGCCGTG<br>GCAAGTCCCCCAGTGACTGCTGCCACAACCAGTGTGCT<br>GCAGGCTGCACAGGCCCCCGGGAGAGCGACTGCCTG<br>GTCTGCCGCAAATTCCGAGACGAAGCCACGTGCAAGG<br>ACACCTGCCCCCCACTCATGCTCTACAACCCCACCACGT<br>ACCAGATGGATGTGAACCCCGAGGGCAAATACAGCTT<br>TGGTGCCACCTGCGTGAAGAAGTGTCCCCGTAATTATG<br>TGGTGACAGATCACGGCTCGTGCGTCCGAGCCTGTGG<br>GGCCGACAGCTATGAGATGGAGGAAGACGGCGTCCG<br>CAAGTGTAAGAAGTGCGAAGGGCCTTGCCGCAAAGTG<br>TGTAACGGAATAGGTATTGGTGAATTTAAAGACTCACT<br>CTCCATAAATGCTACGAATATTAAACACTTCAAAAACT<br>GCACCTCCATCAGTGGCGATCTCCACATCCTGCCGGTG<br>GCATTTAGGGGTGACTCCTTCACACATACTCCTCCTCTG<br>GATCCACAGGAACTGGATATTCTGAAAACCGTAAAGG<br>AAATCACAGGGTTTTTGCTGATTCAGGCTTGGCCTGAA<br>AACAGGACGGACCTCCATGCCTTTGAGAACCTAGAAA<br>TCATACGCGGCAGGACCAAGCAACATGGTCAGTTTTCT<br>CTTGCAGTCGTCAGCCTGAACATAACATCCTTGGGATT<br>ACGCTCCCTCAAGGAGATAAGTGATGGAGATGTGATA<br>ATTTCAGGAAACAAAAATTTGTGCTATGCAAATACAAT<br>AAACTGGAAAAAACTGTTTGGGACCTCCGGTCAGAAA<br>ACCAAAATTATAAGCAACAGAGGTGAAAACAGCTGCA<br>AGGCCACAGGCCAGGTCTGCCATGCCTTGTGCTCCCCC<br>GAGGGCTGCTGGGGCCCGGAGCCCAGGGACTGCGTC<br>TCTTGCCGGAATGTCAGCCGAGGCAGGGAATGCGTGG<br>ACAAGTGCAACCTTCTGGAGGGTGAGCCAAGGGAGTT<br>TGTGGAGAACTCTGAGTGCATACAGTGCCACCCAGAG<br>TGCCTGCCTCAGGCCATGAACATCACCTGCACAGGACG<br>GGGACCAGACAACTGTATCCAGTGTGCCCACTACATTG<br>ACGGCCCCCACTGCGTCAAGACCTGCCCCGGCAGGAGT<br>CATGGGAGAAAACAACACCCTGGTCTGGAAGTACGCA<br>GACGCCGGCCATGTGTGCCACCTGTGCCATCCAAACTG<br>CACCTACGGATGCACTGGGCCAGGTCTTGAAGGCTGT<br>CCAACGAATGGGCCTAAGATCCCGTCCATCGCCACTGG<br>GATGGTGGGGGCCCTCCTCTTGCTGCTGGTGGTGGCC<br>CTGGGGATCGGCCTCTTCATGCGAAGGCGCCACATCG<br>TTCGGAAGCGCACGCTGCGGAGGCTGCTGCAGGAGA<br>GGGAGCTTGTGGAGCCTCTTACACCCAGTGGAGAAGC<br>TCCCAACCAAGCTCTCTTGAGGATCTTGAAGGAAACTG<br>AATTCAAAAAGATCAAAGTGCTGGGCTCCGGTGCGTT<br>CGGCACGGTGTATAAGGGACTCTGGATCCCAGAAGGT<br>GAGAAAGTTAAAATTCCCGTCGCTATCAAGGAATTAA<br>GAGAAGCAACATCTCCGAAAGCCAACAAGGAAATCCT<br>CGATGAAGCCTACGTGATGGCCAGCGTGGACAACCCC<br>CACGTGTGCCGCCTGCTGGGCATCTGCCTCACCTCCAC<br>CGTGCAGCTCATCACGCAGCTCATGCCCTTCGGCTGCC<br>TCCTGGACTATGTCCGGGAACACAAAGACAATATTGG<br>CTCCCAGTACCTGCTCAACTGGTGTGTGCAGATCGCAA<br>AGGGCATGAACTACTTGGAGGACCGTCGCTTGGTGCA<br>CCGCGACCTGGCAGCCAGGAACGTACTGGTGAAAACA<br>CCGCAGCATGTCAAGATCACAGATTTTGGGCTGGCCA<br>AACTGCTGGGTGCGGAAGAGAAAGAATACCATGCAG<br>AAGGAGGCAAAGTGCCTATCAAGTGGATGGCATTGGA<br>ATCAATTTTACACAGAATCTATACCCACCAGAGTGATG |

FIG. 27 Cont.

| sample | Gene Break point 5p | Gene Break point 3p | Frame Type | SEQ ID NO: | Fused Sequence |
|---|---|---|---|---|---|
| | | | | | TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|CTGCAG GACAAGTTCGAGCATCTTAAAATGATTCAACAGGAGG AGATAAGGAAGCTCGAGGAAGAGAAAAAACAACTGG AAGGAGAAATCATAGATTTTTATAAAATGAAAGCTGCC TCCGAAGCACTGCAGACTCAGCTGAGCACCGATACAA AGAAAGACAAACATCGTAAGAAA |
| G17469. TCGA-06-2557-01A-01R-1849-01.2 | 73604248 | 74173110 | InFrame | 8290 | ATGGCGGACTTCGACACCTACGACGATCGGGCCTACA GCAGCTTCGGCGGCGGCAGAGGGTCCCGCGGCAGTG CTGGTGGCCATGGTTCCCGTAGCCAGAAGGAGTTGCC CACAGAGCCCCCTACACAGCATACGTAGGAAATCTAC CTTTCAATACGGTTCAGGGCGACATAGATGCTATCTTT AAGGATCTCAGCATAAGGAGTGTACGGCTAGTCAGAG ACAAAGACACAGATAAATTTAAAGGATTCTGCTATGTA GAATTCGATGAAGTGGATTCCCTTAAGGAAGCCTTGAC ATACGATGGTGCACTGTTGGGCGATCGGTCACTTCGTG TGGACATTGCAGAAGGCAGAAAACAAGATAAAGGTG GCTTTGGATTCAGAAAAGGTGGACCAGATGACAGAG\| AAATAAAAGAGACTGATGGAAGCTCTCAGATCAAGCA AGAACCAGACCCCACGTGG |
| G17785. TCGA-06-5413-01A-01R-1849-01.4 | 32903023 | 34400421 | InFrame | 8291 | ATGTTAACCATGAGCGTGACACTTTCCCCCCTGAGGTC ACAGGACCTGGATCCCATGGCTACTGATGCTTCACCCA TGGCCATCAACATGACACCCACTGTGGAGCAGGGTGA GGGAGAAGAGGCAATGAAGGACATGGACTCTGACCA GCAGTATGAAAAGCCACCCCCACTACACACAGGGGCT GACTGGAAGATTGTCCTCCACTTACCTGAAATTGAGAC CTGGCTCCGGATGACCTCAGAGAGGGTCCGAGACCTA ACCTATTCAGTCCAGCAGGATTCGGACAGCAAGCATGT GGATGTACATCTAGTTCAACTAAAG\|GCAATGGTGGCT TGCTATCCGGGAAATGGAACAGGTTATGTTCGCCACGT GGACAACCCCAACGGTGATGGTCGCTGCATCACCTGC ATCTACTATCTGAACAAGAATTGGGATGCCAAGCTACA TGGTGGGATCCTGCGGATATTTCCAGAGGGGAAATCA TTCATAGCAGATGTGGAGCCCATTTTTGACAGACTCCT GTTCTTCTGGTCAGATCGTAGGAACCCACACGAAGTGC AGCCCTCTTACGCAACCAGATATGCTATGACTGTCTGG TACTTTGATGCTGAAGAAAGGGCAGAAGCCAAAAAGA AATTCAGGAATTTAACTAGGAAAACTGAATCTGCCCTC ACTGAAGAC |
| G17467. TCGA-14-0736-02A-01R-2005-01.2 | 102606509 | 12856191 | InFrame | 8292 | ATGGCGACGGAGGGAGGAGGGAAGGAGATGAACGA GATTAAGACCCAATTCACCACCCGGGAAGGTCTGTACA AGCTGCTGCCGCACTCGGAGTACAGCCGGCCCAACCG GGTGCCCTTCAACTCGCAGGGATCCAACCCTGTCCGCG TCTCCTTCGTAAACCTCAACGACCAGTCTGGCAACGGC GACCGCCTCTGCTTCAATGTGGGCCGGGAGCTGTACTT CTATATCTACAAGGGGGTCCGCAAG\|GAGATTGACCCC AGCCTGGGCGTGGCGGAGCTGCCTGACGAGTTCTTCG AGGAGGACAACATGCTGAGCATGGGCAAGAAGATGA TGCAGGAGGCCATGAGCGCATTTCCCGGCATCGATGA GGCCATGAGCTATGCCGAGGTCATGAGGCTGGTGAAG |

FIG. 27 Cont.

| sample | Gene Break-point 5p | Gene Break-point 3p | Frame Type | SEQ ID NO: | Fused Sequence |
|---|---|---|---|---|---|
| | | | | | GGCATGAACTTCTCGGTGGTGGTATTTGACACGGCACC CACGGGCCACACCCTGAGGCTGCTCAACTTCCCCACCA TCGTGGAGCGGGGCCTGGGCCGGCTTATGCAGATCAA GAACCAGATCAGCCCTTTCATCTCACAGATGTGCAACA TGCTGGGCCTGGGGGACATGAACGCAGACCAGCTGGC CTCCAAGCTGGAGGAGACGCTGCCCGTCATCCGCTCA GTCAGCGAACAGTTCAAGGACCCTGAGCAGACAACTT TCATCTGCGTATGCATTGCTGAGTTCCTGTCCCTGTATG AGACAGAGAGGCTGATCCAGGAGCTGGCCAAGTGCA AGATTGACACACACAATATAATTGTCAACCAGCTCGTC TTCCCCGACCCCGAGAAGCCCTGCAAGATGTGTGAGG CCCGTCACAAGATCCAGGCCAAGTATCTGGACCAGAT GGAGGACCTGTATGAAGCTTCCACATCGTGAAGCTG CCGCTGTTACCCCATGAGGTGCGGGGGGCAGACAAGG TCAACACCTTCTCGGCCCTCCTCCTGGAGCCCTACAAG CCCCCAGTGCCCAG |
| GBM-CUMC33 16_L1 | 22160139 | 58166800 | InFrame | 8293 | atggcggcggcggcggcggcggcggGCGCGGGCCCGGAGATGGT CCGCGGGCAGGTGTTCGACGTGGGGCCGCGCTACACC AACCTCTCGTACATCGGCGAGGGCGCCTACGGCATGG TGTGCTCTGCTTATGATAATGTCAACAAAGTTCGAGTA GCTATCAAGAAAATCAGCCCCTTTGAGCACCAGACCTA CTGCCAGAGAACCCTGAGGGAGATAAAAATCTTACTG CGCTTCAGACATGAGAACATCATTGGAATCAATGACAT TATTCGAGCACCAACCATCGAGCAAATGAAAGATGTAT ATATAGTACAGGACCTCATGGAAACAGATCTTTACAAG CTCTTGAAGACACAACACCTCAGCAATGACCATATCTG CTATTTTCTCTACCAGATCCTCAGAGGGTTAAAATATAT CCATTCAGCTAACGTTCTGCACCGTGACCTCAAGCCTTC CAACCTGCTGCTCAACACCACCTGTGATCTCAAG|GCC CTGAGCCTGTGCAATTATTTCGAGAGTCAAAATGTGGA TTTCCGAGGCAAGAAGGTGATCGAACTGGGTGCGGG GACAGGCATCGTGGGGATCTTGGCAGCGCTGCAGGG GGGGGATGTTACCATCACTGACCTGCCCCTGGCCCTAG AACAGATCCAGGGCAACGTCCAGGCCAATGTGCCAGC TGGAGGCCAGGCCAGGTGCGTGCCTTGTCCTGGGGG ATTGACCATCATGTCTTCCCTGCAAACTATGACCTGGT GCTGGGGGCTGATATCGTGTACCTGGAACCCACCTTCC CTCTGCTGCTGGGGACCCTCCAACACCTGTGCAGGCCC CATGGCACCATCTATCTGGCCTCCAAGATGAGAAAGG AGCATGGGACAGAGAGCTTCTTTCAGCACCTCCTGCCC CAGCATTTCCAACTGGAGCTGGCTCAGCGGGATGAGG ATGAAAATGTCAACATCTATAGGGCCAGGCACAGGGA ACCAAGACCTGCT |
| G17663. TCGA-19-2619-01A-01R-1850-01.2 | 156628525 | 156844698 | InFrame | 8294 | ATGGCCCAGCTGTTCCTGCCCCTGCTGGCAGCCCTGGT CCTGGCCCAGGCTCCTGCAGCTTTAGCAGATGTTCTGG AAGGAGACAGCTCAGAGGACCGCGCTTTTCGCGTGCG CATCGCGGGCGACGCGCCACTGCAGGGCGTGCTCGGC GGCGCCCTCACCATCCCTTGCCACGTCCACTACCTGCG GCCACCGCCGAGCCGCCGGGCTGTGCTGGGCTCTCCG CGGGTCAAGTGGACTTTCCTGTCCCGGGGCCGGGAGG CAGAGGTGCTGGTGGCGCGGGGAGTGCGCGTCAAGG TGAACGAGGCCTACCGGTTCCGCGTGGCACTGCCTGC GTACCCAGCGTCGCTCACCGACGTCTCCCTGGCGCTGA GCGAGCTGCGCCCCAACGACTCAGGTATCTATCGCTGT GAGGTCCAGCACGGCATCGATGACAGCAGCGACGCTG |

FIG. 27 Cont.

| sample | Gene Break-point 5p | Gene Break-point 3p | Frame Type | SEQ ID NO: | Fused Sequence |
|---|---|---|---|---|---|
| | | | | | TGGAGGTCAAGGTCAAAGGGGTCGTCTTTCTCTACCG AGAGGGCTCTGCCCGCTATGCTTTCTCCTTTTCTGGGG CCCAGGAGGCCTGTGCCCGCATTGGAGCCCACATCGC CACCCCGGAGCAGCTCTATGCCGCCTACCTTGGGGGCT ATGAGCAATGTGATGCTGGCTGGCTGTCGGATCAGAC CGTGAGGTATCCCATCCAGACCCCACGAGAGGCCTGTT ACGGAGACATGGATGGCTTCCCCGGGGTCCGGAACTA TGGTGTGGTGGACCCGGATGACCTCTATGATGTGTACT GTTATGCTGAAGACCTAAATGGAGAACTGTTCCTGGGT GACCCTCCAGAGAAGCTGACATTGGAGGAAGCACGG GCGTACTGCCAGGAGCGGGGTGCAGAGATTGCCACCA CGGGCCAACTGTATGCAGCCTGGGATGGTGGCCTGGA CCACTGCAGCCCAGGGTGGCTAGCTGATGGCAGTGTG CGCTACCCCATCGTCACACCCAGCCAGCGCTGTGGTGG GGGCTTGCCTGGTGTCAAGACTCTCTTCCTCTTCCCCAA CCAGACTGGCTTCCCCAATAAGCACAGCCGCTTCAACG TCTACTGCTTCCGAGACTCGGCCCAGCCTTCTGCCATCC CTGAGgcctccaacccagcctccaacccagcctcTGATGGACTA GAGGCTATCGTCACAGTGACAGAGACCCTGGAGGAAC TGCAGCTGCCTCAGGAAGCCACAGAGAGTGAATCCCG TGGGGCCATCTACTCCATCCCCATCATGGAGGACGGA GGAGGTGGAAGCTCCACTCCAGAAGACCCAGCAGAG GCCCCTAGGACGCTCCTAGAATTTGAAACACAATCCAT GGTACCGCCCACGGGGTTCTCAGAAGAGGAAGGTAA GGCATTggaggaagaagagaaatatgaagatgaagaagagaaag aggaggaagaagaagaggaggaggtggaggatgaggCTCTGTGG GCATGGCCCAGCGAGCTCAGCAGCCCGGGCCCTGAGG CCTCTCTCCCCACTGAGCCAGCAGCCCAGGAGGAGTCA CTCTCCCAGGCGCCAGCAAGGGCAGTCCTGCAGCCTG GTGCATCACCACTTCCTGATGGAGAGTCAGAAGCTTCC AGGCCTCCAAGGGTCCATGGACCACCTACTGAGACTCT GCCCACTCCCAGGGAGAGGAACCTAGCATCCCCATCA CCTTCCACTCTGGTTGAGGCAAGAGAGGTGGGGGAGG CAACTGGTGGTCCTGAGCTATCTGGGGTCCCTCGAGG AGAGAGCGAGGAGACAGGAAGCTCCGAGGGTGCCCC TTCCCTGCTTCCAGCCACACGGGCCCCTGAGGGTACCA GGGAGCTGGAGGCCCCCTCTGAAGATAATTCTGGAAG AACTGCCCCAGCAGGGACCTCAGTGCAGGCCCAGCCA GTGCTGCCCACTGACAGCGCCAGCCGAGGTGGAGTGG CCGTGGTCCCCGCATCAGGTGACTGTGTCCCCAGCCCC TGCCACAATGGTGGGACATGCTTGGAGGAGGAGGAA GGGGTCCGCTGCCTATGTCTGCCTGGCTATGGGGGGG ACCTGTGCGATGTTGGCCTCCGCTTCTGCAACCCCGGC TGGGACGCCTTCCAGGGCGCCTGCTACAAGCACTTTTC CACACGAAGGAGCTGGGAGGAGGCAGAGACCCAGTG CCGGATGTACGGCGCGCATCTGGCCAGCATCAGCACA CCCGAGGAACAGGACTTCATCAACAACCGGTACCGGG AGTACCAGTGGATCGGACTCAACGACAGGACCATCGA AGGCGACTTCTTGTGGTCGGATGGCGTCCCCCTGCTCT ATGAGAACTGGAACCCTGGGCAGCCTGACAGCTACTT CCTGTCTGGAGAGAACTGCGTGGTCATGGTGTGGCAT GATCAGGGACAATGGAGTGACGTGCCCTGCAACTACC ACCTGTCCTACACCTGCAAGATGGGGCTGGTGTCCTGT GGGCCGCCACCGGAGCTGCCCCTGGCTCAAGTGTTCG GCCGCCCACGGCTGCGCTATGAGGTGGACACTGTGCT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TCGCTACCGGTGCCGGGAAGGACTGGCCCAGCGCAAT CTGCCGCTGATCCGATGCCAAGAGAACGGTCGTTGGG AGGCCCCCCAGATCTCCTGTGTGCCCAGAAGACCT\|GT CTCGGTGGCTGTGGGCCTGGCCGTCTTTGCCTGCCTCT TCCTTTCTACGCTGCTCCTTGTGCTCAACAAATGTGGAC GGAGAAACAAGTTTGGGATCAACCGCCCGGCTGTGCT GGCTCCAGAGGATGGGCTGGCCATGTCCCTGCATTTCA TGACATTGGGTGGCAGCTCCCTGTCCCCCACCGAGGG CAAAGGCTCTGGGCTCCAAGGCCACATCATCGAGAAC CCACAATACTTCAGTGATGCCTGTGTTCACCACATCAA GCGCCGGGACATCGTGCTCAAGTGGGAGCTGGGGGA GGGCGCCTTTGGGAAGGTCTTCCTTGCTGAGTGCCACA ACCTCCTGCCTGAGCAGGACAAGATGCTGGTGGCTGT CAAGGCACTGAAGGAGGCGTCCGAGAGTGCTCGGCA GGACTTCCAGCGTGAGGCTGAGCTGCTCACCATGCTG CAGCACCAGCACATCGTGCGCTTCTTCGGCGTCTGCAC CGAGGGCCGCCCCCTGCTCATGGTCTTTGAGTATATGC GGCACGGGGACCTCAACCGCTTCCTCCGATCCCATGGA CCTGATGCCAAGCTGCTGGCTGGTGGGAGGATGTGG CTCCAGGCCCCTGGGTCTGGGGCAGCTGCTGGCCGT GGCTAGCCAGGTCGCTGCGGGATGGTGTACCTGGCG GGTCTGCATTTTGTGCACCGGGACCTGGCCACACGCAA CTGTCTAGTGGGCCAGGGACTGGTGGTCAAGATTGGT GATTTTGGCATGAGCAGGGATATCTACAGCACCGACT ATTACCGTGTGGGAGGCCGCACCATGCTGCCCATTCGC TGGATGCCGCCCGAGAGCATCCTGTACCGTAAGTTCAC CACCGAGAGCGACGTGTGGAGCTTCGGCGTGGTGCTC TGGGAGATCTTCACCTACGGCAAGCAGCCCTGGTACC AGCTCTCCAACACGGAGGCAATCGACTGCATCACGCA GGGACGTGAGTTGGAGCGGCCACGTGCCTGCCCACCA GAGGTCTACGCCATCATGCGGGGCTGCTGGCAGCGGG AGCCCCAGCAACGCCACAGCATCAAGGATGTGCACGC CCGGCTGCAAGCCCTGGCCCAGGCACCTCCTGTCTACC TGGATGTCCTGGGC |
| G17203. TCGA-06-0211-02A-02R-2005-01.2 | 54825188 | 55224226 | InFrame | 8295 | ATGGATCAGGTAATGCAGTTTGTTGAGCCAAGTCGGC AGTTTGTAAAGGACTCCATTCGGCTGGTTAAAAGATGC ACTAAACCTGATAGAAAAG\|TGTGTAACGGAATAGGT ATTGGTGAATTTAAAGACTCACTCTCCATAAATGCTAC GAATATTAAACACTTCAAAAACTGCACCTCCATCAGTG GCGATCTCCACATCCTGCCGGTGGCATTTAGGGGTGAC TCCTTCACACATACTCCTCCTCTGGATCCACAGGAACTG GATATTCTGAAAACCGTAAAGGAAATCACAGGGTTTTT GCTGATTCAGGCTTGGCCTGAAAACAGGACGGACCTC CATGCCTTTGAGAACCTAGAAATCATACGCGGCAGGA CCAAGCAACATGGTCAGTTTTCTCTTGCAGTCGTCAGC CTGAACATAACATCCTTGGGATTACGCTCCCTCAAGGA GATAAGTGATGGAGATGTGATAATTTCAGGAAACAAA AATTTGTGCTATGCAAATACAATAAACTGGAAAAAACT GTTTGGGACCTCCGGTCAGAAAACCAAAATTATAAGC AACAGAGGTGAAAACAGCTGCAAGGCCACAGGCCAG GTCTGCCATGCCTTGTGCTCCCCCGAGGGCTGCTGGG GCCCGGAGCCCAGGGACTGCGTCTCTTGCCGGAATGT CAGCCGAGGCAGGGAATGCGTGGACAAGTGCAACCTT CTGGAGGGTGAGCCAAGGGAGTTTGTGAGAACTCTG AGTGCATACAGTGCCACCCAGAGTGCCTGCCTCAGGC |

FIG. 27 Cont.

| sample | Gene Break-point 5p | Gene Break-point 3p | Frame Type | SEQ ID NO: | Fused Sequence |
|---|---|---|---|---|---|
| | | | | | CATGAACATCACCTGCACAGGACGGGGACCAGACAAC TGTATCCAGTGTGCCCACTACATTGACGGCCCCCACTG CGTCAAGACCTGCCCGGCAGGAGTCATGGGAGAAAAC AACACCCTGGTCTGGAAGTACGCAGACGCCGGCCATG TGTGCCACCTGTGCCATCCAAACTGCACCTACGGATGC ACTGGGCCAGGTCTTGAAGGCTGTCCAACGAATGGGC CTAAGATCCCGTCCATCGCCACTGGGATGGTGGGGGC CCTCCTCTTGCTGCTGGTGGTGGCCCTGGGGATCGGCC TCTTCATGCGAAGGCGCCACATCGTTCGGAAGCGCAC GCTGCGGAGGCTGCTGCAGGAGAGGGAGCTTGTGGA GCCTCTTACACCCAGTGGAGAAGCTCCCAACCAAGCTC TCTTGAGGATCTTGAAGGAAACTGAATTCAAAAAGATC AAAGTGCTGGGCTCCGGTGCGTTCGGCACGGTGTATA AGGGACTCTGGATCCCAGAAGGTGAGAAAGTTAAAAT TCCCGTCGCTATCAAGGAATTAAGAGAAGCAACATCTC CGAAAGCCAACAAGGAAATCCTCGATGAAGCCTACGT GATGGCCAGCGTGGACAACCCCCACGTGTGCCGCCTG CTGGGCATCTGCCTCACCTCCACCGTGCAGCTCATCAC GCAGCTCATGCCCTTCGGCTGCCTCCTGGACTATGTCC GGGAACACAAAGACAATATTGGCTCCCAGTACCTGCTC AACTGGTGTGTGCAGATCGCAAAGGGCATGAACTACT TGGAGGACCGTCGCTTGGTGCACCGCGACCTGGCAGC CAGGAACGTACTGGTGAAAACACCGCAGCATGTCAAG ATCACAGATTTTGGGCTGGCCAAACTGCTGGGTGCGG AAGAGAAAGAATACCATGCAGAAGGAGGCAAAGTGC CTATCAAGTGGATGGCATTGGAATCAATTTTACACAGA ATCTATACCCACCAGAGTGATGTCTGGAGCTACGGGG TGACTGTTTGGGAGTTGATGACCTTTGGATCCAAGCCA TATGACGGAATCCCTGCCAGCGAGATCTCCTCCATCCT GGAGAAAGGAGAACGCCTCCCTCAGCCACCCATATGT ACCATCGATGTCTACATGATCATGGTCAAGTGCTGGAT GATAGACGCAGATAGTCGCCCAAAGTTCCGTGAGTTG ATCATCGAATTCTCCAAAATGGCCCGAGACCCCCAGCG CTACCTTGTCATTCAGGGGGATGAAAGAATGCATTTGC CAAGTCCTACAGACTCCAACTTCTACCGTGCCCTGATG GATGAAGAAGACATGGACGACGTGGTGGATGCCGAC GAGTACCTCATCCCACAGCAGGGCTTCTTCAGCAGCCC CTCCACGTCACGGACTCCCCTCCTGAGCTCTCTGAGTG CAACCAGCAACAATTCCACCGTGGCTTGCATTGATAGA AATGGGCTGCAAAGCTGTCCCATCAAGGAAGACAGCT TCTTGCAGCGATACAGCTCAGACCCCACAGGCGCCTTG ACTGAGGACAGCATAGACGACACCTTCCTCCCAGTGCC TGaATACATAAACCAGTCCGTTCCCAAAAGGCCCGCTG GCTCTGTGCAGAATCCTGTCTATCACAATCAGCCTCTG AACCCCGCGCCCAGCAGAGACCCACACTACCAGGACC CCCACAGCACTGCAGTGGGCAACCCCGAGTATCTCAAC ACTGTCCAGCCCACCTGTGTCAACAGCACATTCGACAG CCCTGCCCACTGGGCCCAGAAAGGCAGCCACCAAATT AGCCTGGACAACCCTGACTACCAGCAGGACTTCTTTCC CAAGGAAGCCAAGCCAAATGGCATCTTTAAGGGCTCC ACAGCTGAAAATGCAGAATACCTAAGGGTCGCGCCAC AAAGCAGTGAATTTATTGGAGCA |
| G17784. TCGA-76- 4929- | 9675963 | 9731644 | InFrame | 8296 | ATGAGGCAGTCTCTCCTATTCCTGACCAGCGTGGTTCC TTTCGTGCTGGCGCCGCGACCTCCGGATGACCCGGGC TTCGGCCCCCACCAGAGACTCGAGAAGCTTGATTCTTT |

FIG. 27 Cont.

| sample | Gene Breakpoint 5p | Gene Breakpoint 3p | Frame Type | SEQ ID NO: | Fused Sequence |
|---|---|---|---|---|---|
| 01A-01R-1850-01.4 | | | | | GCTCTCAGACTACGATATTCTCTCTTTATCTAATATCCA GCAGCATTCGGTAAGAAAAAGAGATCTACAGACTTCA ACACATGTAGAAACACTACTAACTTTTTCAGCTTTGAA AAGGCATTTTAAATTATACCTGACATCAAGTACTGAAC GTTTTTCACAAAATTTCAAGGTCGTGGTGGTGGATGGT AAAAACGAAAGCGAGTACACTGTAAAATGGCAGGACT TCTTCACTGGACACGTGGTTGGTGAGCCTGACTCTAGG GTTCTAGCCCACATAAGAGATGATGATGTTATAATCAG AATCAACACAGATGGGGCCGAATATAACATAGAG\|GA ATTGTTGGATAAATATTTAATAGCCAATGCAACTAATC CAGAGAGTAAGGTCTTCTATCTGAAAATGAAGGGTGA TTACTTCCGGTACCTTGCTGAAGTTGCGTGTGGTGATG ATCGAAAACAAACGATAGATAATTCCCAAGGAGCTTAC CAAGAGGCATTTGATATAAGCAAGAAAGAGATGCAAC CCACACACCCAATCCGCCTGGGGCTTGCTCTTAACTTTT CTGTATTTTACTATGAGATTCTTAATAACCCAGAGCTTG CCTGCACGCTGGCTAAAACGGCTTTTGATGAGGCCATT GCTGAACTTGATACACTGAATGAAGACTCATACAAAG ACAGCACCCTCATCATGCAGTTGCTTAGAGACAACCTA ACACTTTGGACATCAGACAGTGCAGGAGAAGAATGTG ATGCGGCAGAAGGGGCTGAAAAC |
| G17675. TCGA-19-2624-01A-01R-1850-01.2 | 55240817 | 65110599 | InFrame | 8297 | ATGGAGGAAGACGGCGTCCGCAAGTGTAAGAAGTGC GAAGGGCCTTGCCGCAAAGTGTGTAACGGAATAGGTA TTGGTGAATTTAAAGACTCACTCTCCATAAATGCTACG AATATTAAACACTTCAAAAACTGCACCTCCATCAGTGG CGATCTCCACATCCTGCCGGTGGCATTTAGGGGTGACT CCTTCACACATACTCCTCCTCTGGATCCACAGGAACTG GATATTCTGAAAACCGTAAAGGAAATCACAGGGTTTTT GCTGATTCAGGCTTGGCCTGAAAACAGGACGGACCTC CATGCCTTTGAGAACCTAGAAATCATACGCGGCAGGA CCAAGCAACAGGACCAGACAACTGTATCCAGTGTGCC CACTACATTGACGGCCCCCACTGCGTCAAGACCTGCCC GGCAGGAGTCATGGGAGAAAACAACACCCTGGTCTGG AAGTACGCAGACGCCGGCCATGTGTGCCACCTGTGCC ATCCAAACTGCACCTACGGATGCACTGGGCCAGGTCTT GAAGGCTGTCCAACGAATGGGCCTAAGATCCCGTCCA TCGCCACTGGGATGGTGGGGGCCCTCCTCTTGCTGCTG GTGGTGGCCCTGGGGATCGGCCTCTTCATGCGAAGGC GCCACATCGTTCGGAAGCGCACGCTGCGGAGGCTGCT GCAGGAGAGGGAG\|ATACAGGTTTGACCCCCGTCTCA TGTTCAGCAATCGCGGCAGTGTCAGGACTCGAAGATTT TCCAAACATCTTCTG |
| G17796. TCGA-41-5651-01A-01R-1850-01.4 | 58166911 | 58163739 | InFrame | 8298 | ATGGCGGACCCCGGCCCAGATCCCGAATCTGAGTCGG AATCGGTGTTCCCGCGGGAGGTCGGGCTCTTTGCAGA CTCTTACTCGGAGAAGAGCCAGTTCTGTTTCTGTGGGC ATGTGCTGACCATCACGCAGAACTTTGGGTCCCGCCTC GGGGTGGCGGCGCGCGTGTGGGACGCGGCCCTGAGC CTGTGCAATTATTTCGAGAGTCAAAATGTGGATTTCCG AGGCAAGAAGGTGATCGAACTGGGTGCGGGGACAGG CATCGTGGGGATCTTGGCAGCGCTGCAGG\|TGGAACT GTCACCGCTGTTCCCAGACACACTTATTCTGGGTCTGG AGATCCGGGTGAAGGTCTCAGACTATGTACAAGACCG GATTCGGGCCCTACGCGCAGCTCCTGCAGGTGGCTTCC AGAACATCGCCTGTCTCCGTAGCAATGCCATGAAGCAC CTTCCTAACTTCTTCTACAAGGGCCAGCTGACAAAGAT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GTTCTTCCTCTTCCCCGACCCACATTTCAAGCGGACAAA GCACAAGTGGCGAATCATCAGTCCCACCCTGCTAGCA GAATATGCCTACGTGCTAAGAGTTGGGGGGCTGGTGT ATACCATAACCGATGTGCTGGAGCTACACGACTGGAT GTGCACTCATTTCGAAGAGCACCCACTGTTTGAGCGTG TGCCTCTGGAGGACCTGAGTGAAGACCCCGTTGTGGG ACATCTAGGCACCTCAACTGAGGAGGGGAAGAAAGTT CTACGTAATGGAGGGAAGAATTTCCCAGCCATCTTCCG AAGAATACAAGATCCCGTCCTCCAGGCAGTGACCTCCC AAACCAGCCTGCCTGGTCAC |
| G17666. TCGA-06- 5415- 01A-01R- 1849- 01.2 | 134210220 | 219103387 | InFrame | 8299 | ATGGTCCCGGCTGCCGGTCGACGACCGCCCCGCGTCA TGCGGCTCCTCGGCTGGTGGCAAGTATTGCTGTGGGT GCTGGGACTTCCCGTCCGCGGCGTGGAGG\|GATACAA TGTCTCTTTGCTATATGACCTTGAAAATCTTCCGGCATC CAAGGATTCCATTGTGCATCAAGCTGGCATGTTGAAGC GAAATTGTTTTGCCTCTGTCTTTGAAAAATACTTCCAAT TCCAAGAAGAGGGCAAGGAAGGAGAGAACAGGGCAG TTATCCATTATAGGGATGATGAGACCATGTATGTTGAG TCTAAAAAGGACAGAGTCACAGTAGTCTTCAGCACAG TGTTTAAGGATGACGACGATGTGGTCATTGGAAAGGT GTTCATGCAGGAGTTCAAAGAAGGACGCAGAGCCAGC CACACAGCCCCACAGGTCCTCTTTAGCCACAGGGAACC TCCTCTGGAGCTGAAAGACACAGACGCCGCTGTGGGT GACAACATTGGCTACATTACCTTTGTGCTGTTCCCTCGT CACACCAATGCCAGTGCTCGAGACAACACCATCAACCT GATCCACACGTTCCGGGACTACCTGCACTACCACATCA AGTGCTCTAAGGCCTATATTCACACACGTATGCGGGCG AAAACGTCTGACTTCCTCAAGGTGCTGAACCGCGCACG CCCAGATGCCGAGAAAAAAGAAATGAAAACAATCACG GGGAAGACGTTTTCATCCCGC |
| G17219. TCGA-06- 0158- 01A-01R- 1849- 01.2 | 42396776 | 41420897 | InFrame | 8300 | ATGGACGGTTTCGCCGGCAGTCTCG\|GTACACTTCATG TTGGTGATGAAATTCGAGAAATCAATGGCATCAGTGT GGCTAACCAAACAGTGGAACAACTGCAAAAAATGCTT AGGGAAATGCGGGGGAGTATTACCTTCAAGATTGTGC CAAGTTACCGCACTCAGTCTTCGTCCTGTGAGAGAGAT TCCCCTTCCACTTCCAGACAGTCCCCAGCTAATGGTCAT AGCAGCACTAACAATTCTGTTTCGGACTTGCCATCAAC TACCCAACCAAAAGGACGACAGATCTATGTAAGAGCA CAATTTGAATATGATCCAGCCAAGGATGACCTCATCCC CTGTAAAGAAGCTGGCATTCGATTCAGAGTTGGTGAC ATCATCCAGATTATTAGTAAGGATGATCATAATTGGTG GCAGGGTAAACTGGAAAACTCCAAAAATGGAACTGCA GGTCTCATTCCTTCTCCTGAACTTCAGGAATGGCGAGT AGCTTGCATTGCCATGGAGAAGACCAAACAGGAGCAG CAGGCCAGCTGTACTTGGTTTGGCAAGAAAAAGAAGC AGTACAAAGATAAATATTTGGCAAAGCACAATGCAGT GTTTGATCAATTAGATCTTGTCACATATGAAGAAGTAG TAAAACTGCCAGCATTCAAGAGGAAAACACTAGTCTTA TTAGGCGCACATGGTGTTGGGAGAAGACACATAAAAA ACACTCTCATCACAAAGCACCCAGACCGGTTTGCGTAC CCTATTCCACATACAACCAGACCTCCAAAGAAAGACGA AGAAAATGGAAAGAATTATTACTTTGTATCTCATGACC AAATGATGCAAGACATCTCTAATAACGAGTACTTGGA GTACGGCAGCCACGAGGATGCGATGTATGGGACAAA ACTGGAGACCATCCGGAAGATCCACGAGCAGGGGCTG |

| sample | Gene Break-point 5p | Gene Break-point 3p | Frame Type | SEQ ID NO: | Fused Sequence |
|---|---|---|---|---|---|
| | | | | | ATTGCAATACTGGACGTGGAGCCTCAGGCACTGAAGG TCCTGAGAACTGCAGAGTTTGCTCCTTTTGTTGTTTTCA TTGCTGCACCAACTATTACTCCAGGTTTAAATGAGGAT GAATCTCTTCAGCGTCTGCAGAAGGAGTCTGACATCTT ACAGAGAACATATGCACACTACTTCGATCTCACAATTA TCAACAATGAAATTGATGAGACAATCAGACATCTGGA GGAAGCTGTTGAGCTCGTGTGCACAGCCCCACAGTGG GTCCCTGTCTCCTGGGTCTAT |
| G17790. TCGA-06-5856-01A-01R-1849-01.4 | 122150670 | 58193703 | InFrame | 8301 | ATGTCCGGGCAGCTGGAGCGTTGCGAGCGCGAATGGC ACGAGCTGGAGGGAGAATTTCAAGAACTGCAG\|GACA TGAAGAATGCAACCCTCTCCCTGAATTCTAATGACAGT GAGCCAAAATATTCCCTATAGCAGTTCTGTTGAAAAA CCAGAATCAGGAGCTGCCTGAGGATGTAAACCCTGCC AAAAAGGAGAATTACCTCTCTGAACAGGACTTTGTGTC TGTGTTTGGCATCACAAGAGGGCAATTTGCAGCTCTGC CTGGCTGGAAACAGCTCCAAATGAAGAAAGAAAGG GGCTTTTC |
| NYU_B | 19746155 | 19433460 | InFrame | 8302 | ATGGGTGGCCCACAGGACAAGGATGAACGCACAATCG CCCTTGTGAGGCCGTGGCCTTGGGGGCACCAGGCCCT GGATCCAGCATATGGCCTGGACACGATGCACCCAAGC AGGCGCAGCCTCCCCTTCCCTCTGAACTGTCAGCTTGC AAGGGTTGGAACTGCTGATTATGGAAGTCCCTCGGAT CAGAGTGATCAGCAGCTGGACTGTGCCTTGGACCTAA TGAGGCGCCTGCCTCCCCAGCAAATCGAGAAAAACCT CAGCGACCTGATCGACCTG\|GATGTCCCCGTTGAGGCC CTCACCACGGTGAAGCCATACTGCAATGAGATCCATGC CCAGGCTCAACTGTGGCTCAAGAGAGACCCCAAGGCA TCCTATGATGCCTGGAAGAAGTGTCTTCCTATCAGAGG GATAGATGGCAATGGGAAAGCCCCCAGCAAATCAGAG CTCCGCCATCTCTATTTGACTGAGAAGTATGTGTGGAG GTGGAAACAGTTCCTGAGTCGTCGGGGGAAGAGGAC CTCCCCCTTGGATCTCAAACTGGGGCATAACAACTGGC TGCGACAAGTGCTTTTCACTCCAGCAACGCAGGCCGCA CGGCAGGCAGCCTGTACCATTGTGGAAGCTCTAGCCA CCATTCCCAGCCGCAAGCAGCAGGTCCTGGACCTGCTT ACCAGTTACCTGGATGAGCTGAGCATAGCTGGGGAGT GTGCAGCTGAGTACCTGGCTCTCTACCAGAAGCTCATC ACTTCTGCGCACTGGAAAGTCTACTTGGCAGCTCGGG GAGTCCTACCCTATGTGGGCAACCTCATCACCAAGGAA ATAGCTCGTCTGCTGGCCCTGGAGGAGGCTACCCTGA GTACCGATCTGCAGCAGGGTTATGCCCTTAAAAGTCTC ACAGGCCTTCTCTCCTCCTTTGTTGAGGTGGAATCCATC AAAAGACATTTTAAAAGTCGCTTGGTGGGTACTGTGCT GAATGGATACCTGTGCTTGCGGAAGCTGGTGGTGCAG AGGACCAAGCTGATCGATGAGACGCAGGACATGCTGC TGGAGATGCTGGAGGACATGACCACAGGTACAGAATC AGAAACCAAGGCCTTCATGGCTGTGTGCATTGAGACA GCCAAGCGCTACAATCTGGATGACTACCGGACCCCGG TGTTCATCTTCGAGAGGCTCTGCAGCATCATTTATCCTG AGGAGAATGAAGTCACTGAGTTCTTTGTGACCCTGGA GAAGGATCCCCAACAAGAAGACTTCTTACAGGGCAGG ATGCCTGGGAACCCGTATAGCAGCAATGAGCCAGGCA TCGGGCCGCTGATGAGGGATATAAAGAACAAGATTTG CCAGGACTGTGACTTAGTGGCCCTCCTGGAAGATGAC AGTGGCATGGAGCTTCTAGTGAACAATAAAATCATTA |

FIG. 27 Cont.

| sample | Gene Break-point 5p | Gene Break-point 3p | Frame Type | SEQ ID NO: | Fused Sequence |
|---|---|---|---|---|---|
| | | | | | GTTTGGACCTTCCTGTGGCTGAAGTTTACAAGAAAGTC TGGTGTACCACGAATGAGGGAGAGCCCATGAGGATTG TTTATCGTATGCGGGGGCTGCTGGGCGATGCCACAGA GGAGTTCATTGAGTCCCTGGACTCTACTACAGatgaaga agaagatgaagaagaagTGTATAAAATGGCTGGTGTGATG GCCCAGTGTGGGGGCCTGGAATGCATGCTTAACAGAC TCGCAGGGATCAGAGATTTCAAGCAGGGACGCCACCT TCTAACAGTGCTACTGAAATTGTTCAGTTACTGCGTGA AGGTGAAAGTCAACCGGCAGCAACTGGTCAAACTGGA AATGAACACCTTGAACGTCATGCTGGGGACCCTAAACC TGGCCCTTGTAGCTGAACAAGAAAGCAAGGACAGTGG GGGTGCAGCTGTGGCTGAGCAGGTGCTTAGCATCATG GAGATCATTCTAGATGAGTCCAATGCTGAGCCCCTGAG TGAGGACAAGGGCAACCTCCTCCTGACAGGTGACAAG GATCAACTGGTGATGCTCTTGGACCAGATCAACAGCAC CTTTGTTCGCTCCAACCCCAGTGTGCTCCAGGGCCTGC TTCGCATCATCCCGTACCTTTCCTTTGGAGAGGTGGAG AAAATGCAGATCTTGGTGGAGCGATTCAAACCATACT GCAACTTTGATAAATATGATGAAGATCACAGTGGTGAT GATAAAGTCTTCCTGGACTGCTTCTGTAAAATAGCTGC TGGCATCAAGAACAACAGCAATGGGCACCAGCTGAAG GATCTGATTCTCCAGAAGGGGATCACCCAGAATGCACT TGACTACATGAAAAAGCACATCCCTAGCGCCAAGAATT TGGATGCCGACATCTGGAAAAAGTTTTTGTCTCGCCCA GCCTTGCCATTTATCCTAAGGCTGCTTCGGGGCCTGGC CATCCAGCACCCTGGCACCCAGGTTCTGATTGGAACTG ATTCCATCCCGAACCTGCATAAGCTGGAGCAGGTGTCC AGTGATGAGGGCATTGGGACCTTGGCAGAGAACCTGC TGGAAGCCCTGCGGGAACACCCTGACGTAAACAAGAA GATTGACGCAGCCCGCAGGGAGACCCGGGCAGAGAA GAAGCGCATGGCCATGGCAATGAGGCAGAAGGCCCT GGGCACCCTGGGCATGACGACAAATGAAAAGGGCCA GGTCGTGACCAAGACAGCACTCCTGAAGCAGATGGAA GAGCTGATCGAGGAGCCTGGCCTCACGTGCTGCATCT GCAGGGAGGGATACAAGTTCCAGCCCACAAAGGTCCT GGGCATTTATACCTTCACGAAGCGGGTAGCCTTGGAG GAGATGGAGAATAAGCCCCGGAAACAGCAGGGCTAC AGCACCGTGTCCCACTTCAACATTGTGCACTACGACTG CCATCTGGCTGCCGTCAGGTTGGCTCGAGGCCGGGAA GAGTGGGAGAGTGCCGCCCTGCAGAATGCCAACACCA AGTGCAACGGGCTCCTTCCGGTCTGGGGACCTCATGTC CCTGAATCAGCTTTTGCCACTTGCTTGGCAAGACACAA CACTTACCTCCAGGAATGTACAGGCCAGCGGGAGCCC ACGTATCAGCTCAACATCCATGACATCAAACTGCTCTTC CTGCGCTTCGCCATGGAGCAGTCGTTCAGCGCAGACA CTGGCGGGGCGGCCGGGAGAGCAACATCCACCTGA TCCCGTACATCATTCACACTGTGCTTTACGTCCTGAACA CAACCCGAGCAACTTCCCGAGAAGAGAAGAACCTCCA AGGCTTTCTGGAACAGCCCAAGGAGAAGTGGGTGGA GAGTGCCTTTGAAGTGGACGGGCCCTACTATTTCACAG TCTTGGCCCTTCACATCCTGCCCCCTGAGCAGTGGAGA GCCACACGTGTGGAAATCTTGCGGAGGCTGTTGGTGA CCTCGCAGGCTCGGGCAGTGGCTCCAGGTGGAGCCAC CAGGCTGACAGATAAGGCAGTGAAGGACTATTCCGCT TACCGTTCTTCCCTTCTCTTTTGGGCCCTCGTCGATCTC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | ATTTACAACATGTTTAAGAAACAAACAACCCCAACTGTGGGAGGGATTGACACTGGCAGCCTGGGAGCCTTGTGTCTGTGAGAAGGTGCCTACCAGTAACACAGAGGGAGGCTGGTCCTGCTCTCTCGCTGAGTACATCCGCCACAACGACATGCCCATCTACGAAGCTGCCGACAAAGCCCTGAAAACCTTCCAGGAGGAGTTCATGCCAGTGGAGACCTTCTCAGAGTTCCTCGATGTGGCCGGTCTTTTATCAGAAATCACCGATCCAGAGAGCTTCCTGAAGGACCTGTTGAACTCAGTCCCC |
| G17657.TCGA-19-1787-01B-01R-1850-01.2 | 100438902 | 100348442 | InFrame | 8303 | ATGAACGGACAGTTGGATCTAAGTGGGAAGCTAATCATCAAAGCTCAACTTGGGGAGGATATTCGGCGAATTCCTATTCATAATGAAGATATTACTTATGATGAATTAGTGCTAATGATGCAACGAGTTTTCAGAGGAAAACTTCTGAGTAATGATGAAGTAACAATAAAGTATAAAGATGAAGATGGAGATCTTATAACAATTTTTGATAGTTCTGACCTTTCCTTTGCAATTCAGTGCAGTAGGATACTGAAACTGACATTATTTG\|GAAAATCTACTTCCTCATCAAGCACCCCTACAGAGTTCTGCAGGAATGGTGGAACCTGGGAAAATGGCAGATGTATTTGTACAGAAGAGTGGAAAGGACTGAGATGTACAATTGCTAATTTTTGTGAAAATAGTACCTATATGGGTTTTACTTTTGCCAGAATCCCAGTGGGCAGATATGGACCATCCTTGCAAACATGTGGCAAGGATACTCCAAATGCGGGCAATCCAATGGCAGTCCGGTTGTGCAGTCTCTCTCTATATGGAGAGATAGAATTACAAAAAGTGACAATAGGAAATTGCAATGAAAATCTGGAAACCCTGGAAAAGCAGGTAAAGGATGTCACAGCACCACTTAATAACATTTCTTCTGAAGTCCAGATTTTAACATCTGATGCCAATAAATTAACTGCTGAGAACATCACTAGTGCTACGCGAGTGGTTGGACAGATATTCAACACTTCCAGAAATGCTTCACCTGAGGCAAGAAAGTTGCCATAGTAACAGTGAGTCAACTCCTAGATGCCAGTGAAGATGCTTTTCAAAGAGTTGCTGCTACTGCTAATGATGATGCCCTTACAACGCTTATTGAGCAAATGGAGACTTATTCCTTGTCTTTGGGTAATCAATCAGTGGTGGAACCTAACATAGCAATACAGTCAGCAAATTTCTCTTCAGAAAATGCGGTGGGGCCTTCAAATGTTCGCTTCTCTGTGCAGAAAGGAGCTAGCAGTTCTCTAGTTTCTAGTTCAACATTTATACATACAAATGTGGATGGCCTTAACCCAGATGCACAGACTGAGCTTCAGGTCTTGCTTAATATGACGAAAAATTACACCAAGACATGCGGCTTTGTAGTTTATCAAAATGACAAGCTTTTCCAATCAAAAACTTTTACAGCTAAATCGGATTTTAGTCAAAAAATTATCTCAAGCAAAACTGATGAAAATGAGCAAGATCAGAGTGCTTCTGTTGACATGGTCTTTAGTCCAAAGTACAACCAAAAAGAATTTCAACTCTATTCCTATGCCTGTGTCTATTGGAATTTGTCAGCGAAGGACTGGGACACATATGGCTGTCAAAAAGACAAGGGCACTGATGGATTCCTGCGCTGCCGCTGCAACCATACTACTAATTTTGCTGTATTAATGACTTTCAAAAAGGATTATCAATATCCCAAATCACTTGACATATTATCCAACGTTGGATGTGCACTGTCTGTTACTGGTCTGGCTCTCACAGTTATATTTCAGATTGTCACCAGGAAAGTCAGAAAAACCTCAGTAACCTGGGTTTTGGTCAATCTGTGCATATCAATGTTGATTTTCAACCTCCTCTTTGTGTTTGGAATTGAAAACTCCAATAAGAACTTGCAGACAAGTGATGGTGACATCAATAATATTGACTTTGACAATAATGACATACCCAGGACAGACACCATTAACATCCCGAATCCCATGTGCACTGCGATTGC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CGCCTTACTGCACTATTTTCTGTTAGTGACATTTACCTG GAACGCACTCAGCGCTGCACAGCTCTATTACCTTCTAA TAAGGACCATGAAGCCTCTTCCTCGGCATTTCATTCTTT TCATCTCATTAATTGGATGGGGAGTCCCAGCTATAGTA GTGGCTATAACAGTGGGAGTTATTTATTCTCAGAATGG AAATAATCCACAGTGGGAATTAGACTACCGGCAAGAG AAAATCTGCTGGCTGGCAATTCCAGAACCCAATGGTGT TATAAAAAGTCCGCTGTTGTGGTCATTCATCGTACCTG TAACCATTATCCTCATCAGCAATGTTGTTATGTTTATTA CAATCTCGATCAAAGTGCTGTGGAAGAATAACCAGAA CCTGACAAGCACAAAAAAAGTTTCATCCATGAAGAAG ATTGTTAGCACATTATCTGTTGCAGTTGTTTTTGGAATT ACCTGGATTCTAGCATACCTGATGCTAGTTAATGATGA TAGCATCAGGATCGTCTTCAGCTACATATTCTGCCTTTT CAACACTACACAGGGATTGCAAATTTTTATCCTGTACA CTGTTAGAACAAAAGTCTTCCAGAGTGAAGCTTCCAAA GTGTTGATGTTGCTATCGTCTATTGGGAGAAGGAAGTC ATTGCCTTCAGTGACGCGGCCGAGGCTGCGTGTAAAG ATGTATAATTTCCTCAGGTCATTGCCAACCTTACATGAA CGCTTTAGGCTACTGGAAACCTCTCCGAGTACTGAGGA AATCACACTCTCTGAAAGTGACAATGCAAAGGAAAGC ATC |
| G17643. TCGA-12-5295-01A-01R-1849-01.2 | 43976965 | 52740660 | InFrame | 8304 | ATGGCCCCCGCCCGTCTGTTCGCGCTGCTGCTGTTCTTC GTAGGCGGAGTCGCCGAGTCG\|GATTACAAGGGCCAG AAGCTAGCTGAACAGATGTTTCAGGGAATTATTCTTTT TTCTGCAATAGTTGGATTTATCTACGGGTACGTGGCTG AACAGTTCGGGTGGACTGTCTATATAGTTATGGCCGG ATTTGCTTTTTCATGTTTGCTGACACTTCCTCCATGGCC CATCTATCGCCGGCATCCTCTCAAGTGGTTACCTGTTCA AGAATCAAGCACAGACGACAAGAAACCAGGGGAAAG AAAAATTAAGAGGCATGCTAAAAATAAT |
| NYU_G | 100191807 | 102260661 | InFrame | 8305 | ATGCGCTCCATTAGGAAGAGGTGGACGATCTGCACAA TAAGTCTGCTCCTGATCTTTTATAAGACAAAAGAAATA GCAAGAACTGAGGAGCACCAGGAGACGCAACTCATCG GAGATGGTGAATTGTCTTTGAGTCGGTCACTTGTCAAT AGCTCTGATAAAATCATTCGAAAGGCTGGCTCTTCAAT CTTCCAGCACAATGTAGAAGGTTGGAAAATCAATTCCT CTTTGGTCCTAGAGATAAGGAAGAACATACTTCGTTTC TTAGATGCAGAACGAGATGTGTCAGTGGTCAAGAGCA GTTTTAAGCCTGGTGATGTCATACACTATGTGCTTGAC AGGCGCCGGACACTAAACATTTCTCATGATCTACATAG CCTCCTACCTGAAGTTTCACCAATGAAGAATCGCAGGT TTAAGACCTGTGCAGTTGTTGGAAATTCTGGCATTCTG TTAGACAGTGAATGTGGAAAGGAGATTGACAGTCACA ATTTTGTAATAAGGTGTAATCTAGCTCCTGTGGTGGAG TTTGCTGCAGATGTGGGAACTAAATCAGATTTTATTAC CATGAATCCATCAGTTGTACAAAGAGCATTTGGAGGCT TTCGAAATGAGAGTGACAGAGAAAAATTTGTGCATAG ACTTTCCATGCTGAATGACAGTGTCCTTTGGATTCCTGC TTTCATGGTCAAAGGAGGAGAGAAGCACGTGGAGTG GGTTAATGCATTAATCCTTAAGAATAAACTGAAAGTGC GAACTGCCTATCCGTCATTGAGACTTATTCATGCTGTCA GAGG\|GTTTTGTGATGAAGGAACCTGTACAGATAAAG CCAATATTCTGTATGCCTGGGCGAGAAATGCTCCCCCT ACCCGGCTCCCCAAAGGTGTTGGATTCAGAGTTGGAG |

FIG. 27 Cont.

| sample | Gene Break- point 5p | Gene Break- point 3p | Frame Type | SEQ ID NO: | Fused Sequence |
|---|---|---|---|---|---|
| | | | | | GAGAGACTGGAAGTAAATACTTTGTACTACAGGTACA CTATGGGGATATTAGTGCTTTTAGAGATAATAACAAGG ACTGTTCTGGTGTGTCCTTACACCTCACACGTCTGCCAC AGCCTTTAATTGCTGGCATGTACCTTATGATGTCTGTTG ACACTGTTATCCCAGCAGGAGAAAAAGTGGTGAATTC TGACATTTCATGCCATTATAAAAATTATCCAATGCATGT CTTTGCCTATAGAGTTCACACTCACCATTTAGGTAAGG TAGTAAGTGGATACAGAGTAAGAAATGGACAGTGGAC ACTGATTGGACGGCAGAGCCCTCAGCTGCCACAGGCT TTCTACCCTGTGGGGCATCCAGTTGATGTAAGTTTTGG TGACCTACTGGCTGCAAGATGTGTATTCACTGGTGAAG GAAGGACAGAAGCCACACACATTGGTGGCACGTCTAG TGATGAAATGTGCAACTTATACATTATGTATTACATGG AAGCCAAGCATGCAGTTTCTTTCATGACCTGTACCCAG AATGTAGCTCCAGATATGTTCAGAACCATACCACCAGA GGCCAACATTCCAATTCCCGTGAAGTCTGATATGGTTA TGATGCATGAACATCATAAAGAAACAGAATATAAAGA TAAGATTCCTTTACTACAGCAGCCAAAACGAGAAGAA GAAGAAGTGTTAGACCAGGGTGATTTCTATTCACTACT TTCCAAGCTGCTAGGAGAAAGGGAAGATGTTGTTCAT GTGCACAAATATAATCCTACAGAAAAGGCAGAATCAG AGTCAGACCTGGTAGCTGAGATTGCAAATGTAGTCCA AAAAAAGGATCTTGGTCGATCTGATGCCAGAGAGGGT GCAGAACATGAGAGGGGTAATGCTATTCTTGTCAGAG ACAGAATTCACAAATTCCACAGACTAGTATCTACCTTG AGGCCACCAGAGAGCAGAGTTTTCTCATTACAGCAGC CCCCACCTGGTGAAGGCACCTGGGAACCAGAACACAC AGGAGATTTCCACATGGAAGAGGCACTGGATTGGCCT GGAGTATACTTGTTACCAGGCCAGGTTTCTGGGGTGG CTCTAGACCCTAAGAATAACCTGGTGATTTTCCACAGA GGTGACCATGTCTGGGATGGAAACTCGTTTGACAGCA AGTTTGTTTACCAGCAAATAGGACTCGGACCAATTGAA GAAGACACTATTCTTGTCATAGATCCAAATAATGCTGC AGTACTCCAGTCCAGTGGAAAAAATCTGTTTTACTTGC CACATGGCTTGAGTATAGATAAAGATGGGAATTATTG GGTCACAGACGTGGCTCTCCATCAGGTGTTCAAACTGG ATCCAAACAATAAAGAAGGCCCTGTATTAATCCTGGGA AGGAGCATGCAACCAGGCAGTGACCAGAATCACTTCT GTCAACCCACTGATGTGGCTGTGGATCCAGGCACTGG AGCCATTTATGTATCAGATGGTTACTGCAACAGCAGGA TTGTGCAGTTTTCACCAAGTGGAAAGTTCATCACACAG TGGGGAGAAGAGTCTTCAGGGAGCAGTCCTCTGCCAG GCCAGTTCACTGTTCCTCACAGCTTGGCTCTTGTGCCTC TTTTGGGCCAATTATGTGTGGCAGACCGGGAAAATGG TCGGATCCAGTGTTTTAAAACTGACACCAAAGAATTTG TGAGAGAGATTAAGCATTCATCATTTGGAAGAAATGT ATTTGCAATTTCATATATACCAGGCTTGCTCTTTGCAGT GAATGGGAAGCCTCATTTTGGGGACCAAGAACCTGTA CAAGGATTTGTGATGAACTTTTCCAATGGGGAAATTAT AGACATCTTCAAGCCAGTGCGCAAGCACTTTGATATGC CTCATGATATTGTTGCATCTGAAGATGGGACTGTGTAC ATTGGAGATGCTCATACCAACACCGTGTGGAAGTTCAC CTTGACTGAGAAATTGGAACATCGATCAGTTAAAAAG GCTGGCATTGAGGTCCAGGAAATCAAAGAAGCCGAG GCAGTTGTTGAAACCAAAATGGAGAACAAACCCACCT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CCTCAGAATTGCAGAAGATGCAAGAGAAACAGAAACT GATCAAAGAGCCAGGCTCGGGAGTGCCTGTTGTTCTC ATTACAACCCTTCTGGTTATTCCGGTGGTTGTCCTGCTG GCCATTGCCATATTTATTCGGTGGAAAAAATCAAGGGC CTTTGGAGCAGATTCTGAACACAAACTCGAGACGAGTT CAGGAAGAGTACTGGGAAGATTTAGAGGAAAGGGAA GTGGAGGCTTAAACCTTGGTAATTTCTTTGCAAGCCGT AAGGGCTACAGTCGAAAAGGGTTTGACCGGCTTAGCA CTGAGGGCAGTGACCAAGAGAAAGAGGATGATGGAA GTGAATCAGAAGAGGAGTATTCAGCACCTCTGCCTGC GCTCGCACCTTCCTCCTCC |
| G17494. TCGA-14-2554-01A-01R-1850-01.2 | 48965246 | 48265844 | InFrame | 8306 | ATGTCAGTGGACATGAATAGCCAGGGGTCTGACAGCA ATGAAGAGGACTATGACCCAAATTGTgaggaagaggaaga agaagaagaagaCGACCCTGGGGACATAGAGGACTATTA CGTGGGAGTAGCCAGCGATGTGGAGCAGCAGGGGGC TGATGCCTTTGATCCCGAGGAGTACCAGTTCACTTGCT TGACCTACAAGGAATCTGAGGGTGCCCTCAATGAGCA CATGACCAGCTTAGCTTCTGTCCTAAAG|GATGGGGAC CCAGACACGCCAAAGCCTGTGAGCTTCACAGTGAAGG AGACAGTGTGCCCCAGGACGACACAGCAGTCACCAGA GGATTGTGACTTCAAGAAGGACGGGCTGGTGAAGCG GTGTATGGGGACAGTGACCCTCAACCAGGCCAGGGGC TCCTTTGACATCAGTTGTGATAAGGATAACAAGAGATT TGCCCTGCTGGGTGATTTCTTCCGGAAATCTAAAGAGA AGATTGGCAAAGAGTTTAAAAGAATTGTCCAGAGAAT CAAGGATTTTTTGCGGAATCTTGTACCCAGGACAGAGT CC |
| G17196. TCGA-06-0178-01A-01R-1849-01.2 | 58123422 | 94827533 | InFrame | 8307 | ATGAGCCGGGGCGCGGGCGCGCTTCAGCGCCGGACA ACGACCTACCTCATCTCGCTGACCCTGGTTAAGCTCGA gtcggtgcctccgccgccgccttctccgtctgcggccgcggccggcgcc gccggtgccAGAGGCTCCGAGACTGGGGATCCTGGCAGC CCCCGAGGCGCGGAGGAGCCGGGCAAGAAGCGGCAC GAACGTCTCTTCCACCGGCAGGATGCGCTGTGGATCA GCACGAGCAGCGCGGGCACCGGGGGCGCGGAGCCCC CAGCCCTGTCCCCGGCTCCGGCCAGTCCGGCCCGCCCA GTCTCCCCCGCTCCCGGCCGCCGCCTCTCCCTCTGGGC CGTCCCTCCGGGACCCCCGCTCTCCGGGGGACTGAGC CCCGACCCCAAGCCTGGGGGCGCCCCCACCTCCTCCCG GCGCCCCTGCTCAGCAGCCCGAGCTGGGGCGGCCCG GAGCCCGAAGGCCGGGCGGGCGGCGGCATCCCTGGC TCATCCTCTCCGCACCCTGGCACCGGCAGCCGGAGGCT CAAGGTGGCGCCTCCTCCGCCGGCTCCCAAGCCTTGCA AGACCGTGACCACGAGTGGAGCCAAAGCCGGCGGGG GCAAGGGCGCGGGTAGCCGCCTGTCATGGCCCGAAA GCGAGGGCAAGCCCAGGGTCAAGGGGTCAAAGAGCA GCGCCGGGACTGGAGCTTCGGTCTCTgccgccgccaccgcc gccgccgccgGGGGAGGGGGCTCTACAGCTTCGACCTCT GGTGGGGTCGGGGCTGGGGCTGGAGCCCGAGGGAA GTTGTCCCCTCGGAAAGGCAAGAGTAAGACCTTGGAC AACAGTGACTTGCATCCGGGACCGCCTGCCGGCTCTCC TCCTCCGCTAACCCTCCCACCAACTCCGAGTCCAGCCAC TGCTGTCACCGCTGCTTCCGCGCAGCCCCCCGGGCCTG CACCTCCAATCACTCTGGAGCCTCCAGCTCCGGGGCTG AAACGGGGCCGGGAGGGGGGCCGAGCATCCACTCGT GACCGCAAGATGCTCAAGTTTATCAGCGGCATCTTCAC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CAAGAGCACAGGAGGGCCTCCTGGCTCCGGGCCCCTT<br>CCCGGACCCCCCAGCCTGTCTTCTGGCAGCGGGTCCAG<br>GGAGCTGCTGGGCGCCGAGCTCCGCGCTTCCCCTAAG<br>GCTGTGATCAATAGCCAGGAATGGACTTTGAGCCGCT<br>CCATTCCTGAACTGCGCCTGGGTGTGCTGGGCGATGCC<br>AGGAGTGGGAAGTCATCGCTCATCCACCGATTCCTGAC<br>TGGCTCATACCAGGTGCTGGAGAAGACAGAGAGTGA<br>GCAGTACAAGAAAGAAATGTTGGTGGATGGACAGAC<br>ACATCTGGTGCTAATCCGAGAGGAAGCTGGGGCACCT<br>GATGCCAAGTTCTCAGGCTGGGCAGATGCTGTGATCTT<br>CGTCTTCAGCCTGGAGGATGAGAACAGTTTCCAGGCT<br>GTGAGCCGTCTCCATGGGCAGCTGAGTTCCCTTCGCGG<br>GGAGGGACGAGGAGGCCTGGCCTTGGCACTGGTGGG<br>GACACAAGACAGGATCAGTGCTTCCTCCCCTCGGGTG<br>GTGGGAGATGCTCGTGCCAGAGCTCTGTGCGCGGACA<br>TGAAACGCTGCAGCTACTATGAGACTTGTGCAACCTAT<br>GGGCTCAATGTGGATCGGGTCTTCCAGGAGGTGGCCC<br>AGAAGGTGGTGACCTTGCGCAAGCAGCAACAGCTTCT<br>GGCTGCCTGCAAGTCCCTGCCCAGCTCCCCAAGCCACT<br>CAGCTGCATCCACTCCGGTAGCTGGCCAGGCTAGTAAC<br>GGGGGCCACACTAGCGACTACTCTTCTTCCCTCCCGTC<br>CTCACCGAATGTTGGTCACCGGGAGCTCCGAGCCGAG<br>GCAGCTGCAGTGGCTGGATTGAGCACCCCAGGGTCCC<br>TGCACCGGGCAGCCAAGCGCAGGACCAGCCTTTTTGC<br>GAATCGTCGGGGTAGTGACTCCGAGAAACGAAGCTTG<br>GATAGTCGGGGAGAGACAACAGGGAGTGGGCGAGCC<br>ATCCCCATCAAACAGAGCTTCCTACTAAAACGAAGTGG<br>CAATTCCTTGAACAAAGAATGGAAGAAGAAATATGTA<br>ACCCTGTCCAGTAATGGCTTTCTACTCTACCACCCCAGT<br>ATTAACGATTACATCCACAGTACCCACGGCAAGGAGAT<br>GGACTTGCTGCGAACAACAGTCAAAGTCCCGGGCAAG<br>CGGCCCCCGAGGGCCATCTCTGCCTTTGGCCCCTCAGC<br>CAGCATTAACGGGCTCGTCAAGGACATGAGCACTGTC<br>CAGATGGGTGAAGGCCTGGAAGCCACTACTCCCATGC<br>CAAGCCCTAGCCCCAGCCCCAGTTCCCTGCAGCCACCA<br>CCAGATCAGACATCCAAACACCTGCTGAAGCCAGACC<br>GGAATTTGGCCCGAGCCCTCAGCACGGACTGTACCCC<br>ATCTGGAGACCTGAGCCCCCTGAGTCGGGAACCCCCTC<br>CTTCTCCCATGGTGAAGAAGCAGAGGAGGAAAAAATT<br>GACAACACCATCCAAGACTGAAGGCTCGGCTGGGCAG<br>GCTGAAG\|ATGAAGGTTATTCTTTCAGCAGTGTCCTGT<br>ATTATGGAAATGAAGCTACTCTTCTTATTTTTGATCTGC<br>TGTTCTTCTGTGTTGTGGATTTGGCTTGCCAAAATTTTA<br>TTTTAGCATCCTTCCTTACATATCTACAACAAGAGATTT<br>TTAGATATATCCGTAATACAGTAGGACAAAAGAATTTG<br>GCATCCAAAACATTGGTGGATCAAAGATTTTTTGATT |
| G17782.<br>TCGA-26-<br>5136-<br>01B-01R-<br>1850-<br>01.4 | 95392394 | 95448862 | InFrame | 8308 | ATGACCCACTTCAACAAGGGCCCTTCCTATGGGCTCTC<br>GGCCGAAGTCAAGAACAAG\|GTGTTGTGTAACGGACC<br>AGGAACATGTGTTCCTATCTGTGTATCTGCCCTTCTCCT<br>TGGGATACTAGGAATAAAGAAAGTGATCATTGTCTAC<br>GTTGAAAGCATCTGCCGTGTAGAAACGTTATCCATGTC<br>CGGAAAGATTCTGTTTCATCTCTCAGATTACTTCATTGT<br>TCAGTGGCCGGCTCTGAAAGAAAAGTATCCCAAATCG<br>GTGTACCTTGGGCGAATTGTT |

FIG. 27 Cont.

| sample | Gene Break-point 5p | Gene Break-point 3p | Frame Type | SEQ ID NO: | Fused Sequence |
|---|---|---|---|---|---|
| GBM-CUMC3296_L1 | 55639964 | 68645358 | InFrame | 8309 | ATGAGGCGCCAGCCTGCGAAGGTGGCGGCGCTGCTGC TCGGGCTGCTCTTGGAG\|CATATTGAAGGTGATGACCT GCATATCCAGAGGAATGTGCAAAAGCTGAAGGACACA GTGAAAAAGCTTGGAGAGAGTGGAGAGATCAAAGCA ATTGGAGAACTGGATTTGCTGTTTATGTCTCTGAGAAA TGCCTGCATT |
| G17199. TCGA-06-0744-01A-01R-1849-01.2 | 55087058 | 102784508 | InFrame | 8310 | ATGCGACCCTCCGGGACGGCCGGGGCAGCGCTCCTGG CGCTGCTGGCTGCGCTCTGCCCGGCGAGTCGGGCTCT GGAGGAAAAGAAAG\|CTGACATAGCCCAGAGATACA GGATAAGCAAATACCCAACCCTCAAATTGTTTCGTAAT GGGATGATGATGAAGAGAATACAGGGGTCAGCGA TCAGTGAAAGCATTGGCAGATTACATCAGGCAACAAA AAAGTGACCCCATTCAAGAAATTCGGGACTTAGCAGA AATCACCACTCTTGATCGCAGCAAAAGAAATATCATTG GATATTTTGAGCAAAAGGACTCGGACAACTATAGAGT TTTTGAACGAGTAGCGAATATTTTGCATGATGACTGTG CCTTTCTTTCTGCATTTGGGGATGTTTCAAAACCGGAA AGATATAGTGGCGACAACATAATCTACAAACCACCAG GGCATTCTGCTCCGGATATGGTGTACTTGGGAGCTATG ACAAATTTTGATGTGACTTACAATTGGATTCAAGATAA ATGTGTTCCTCTTGTCCGAGAAATAACATTTGAAAATG GAGAGGAATTGACAGAAGAAGGACTGCCTTTTCTCAT ACTCTTTCACATGAAAGAAGATACAGAAAGTTTAGAAA TATTCCAGAATGAAGTAGCTCGGCAATTAATAAGTGAA AAAGGTACAATAAACTTTTTACATGCCGATTGTGACAA ATTTAGACATCCTCTTCTGCACATACAGAAAACTCCAG CAGATTGTCCTGTAATCGCTATTGACAGCTTTAGGCAT ATGTATGTGTTTGGAGACTTCAAAGATGTATTAATTCC TGGAAAACTCAAGCAATTCGTATTTGACTTACATTCTG GAAAACTGCACAGAGAATTCCATCATGGACCTGACCC AACTGATACAGCCCCAGGAGAGCAAGCCCAAGATGTA GCAAGCAGTCCACCTGAGAGCTCCTTCCAGAAACTAGC ACCCAGTGAATATAGGTATACTCTATTGAGGGATCGA GATGAGCTT |
| G17792. TCGA-28-5204-01A-01R-1850-01.4 | 69960029 | 8298288 | InFrame | 8311 | ATGACTGATGGAAAACTCTCCACCTCTACAAATGGCGT AGCCTTCATGGGTATTCTGGATGGTCGACCAGGAAAC CCCCTTCAGAACCTGCAACACGTCAATCTCAAGGCGCC CCGACTCCTCTCCGCGCCTGAGTACGGGCCCAAGCTGA AACTCAGGGCTTTAGAAGACCGGCACAGCCTCCAGTC CGTGGACTCGGGGATTCCTACCCTGGAGATCGGGAAC CCGGAGCCTGTACCCTGCAGCGCGGTCCACGTGAGGA GGAAGCAGTCCGACTCCGACCTCATCCCCGAGCGGGC CTTCCAGAGCGCCTGCGCGCTGCCATCCTGTGCGCCAC CAGCTCCTAGCAGCACCGAGCGGGAACAGAGCGTGCG CAAATCCTCCACGTTTCCCAGGACAGGCTATGACTCGG TAAAGCTCTATAGCCCGACCTCCAAAGCCCTGACCCGC AGCGATGATGTCTCCGTCTGCAGCGTGTCCAGTCTTGG GACAGAGCTGTCCACCACGCTGTCCGTCAGCAATGAG GACATCTTGGACCTTGTGGTCACGAGCAGCTCCAGTGC CATTGTGACCCTGGAGAATGACGATGACCCACAGTTTA CCAACGTCACCTTGAGCTCTATCAAGGAAACCCGTGGC TTACACCAGCAGGACTGTGTTCATGAAGCTGAGGAGG GGAGTAAATTGAAAATATTGGGGCCATTTAGTAACTTC TTTGCAAGGAACTTGCTTGCTAGAAAACAAAGTGCAA GGCTTGACAAACACAATGACTTGGGATGGAAGTTATTT |

FIG. 27 Cont.

| sample | Gene Break-point 5p | Gene Break-point 3p | Frame Type | SEQ ID NO: | Fused Sequence |
|---|---|---|---|---|---|
| | | | | | GGGAAAGCGCCACTCCGAGAGAATGCCCAGAAGGATT CAAAGAGAATACAGAAGgaatatgaagacaaggctggaagac ctagCAAGCCACCCTCTCCAAAGCAGAATGTGAGGAAG AATCTTGACTTTGAACCACTTTCCACCACCGCACTCATC CTCGAGGACAGACCAGC\|ACACCCGCTGTTTGGCCGCA ACGTGCCCCTGTCCAGCGGTTCTGGCTTCATCATGTCA GAGGCCGGCCTGATCATCACCAATGCCCACGTGGTGT CCAGCAACAGTGCTGCCCCGGGCAGGCAGCAGCTCAA GGTGCAGCTACAGAATGGGGACTCCTATGAGGCCACC ATCAAAGACATCGACAAGAAGTCGGACATTGCCACCA TCAAGATCCATCCCAAGAAAAAGCTCCCTGTGTTGTTG CTGGGTCACTCGGCCGACCTGCGGCCTGGGGAGTTTG TGGTGGCCATCGGCAGTCCCTTCGCCCTACAGAACACA GTGACAACGGGCATCGTCAGCACTGCCCAGCGGGAGG GCAGGGAGCTGGGCCTCCGGGACTCCGACATGGACTA CATCCAGACGGATGCCATCATCAACTACGGGAACTCCG GGGGACCACTGGTGAACCTGGATGGCGAGGTCATTGG CATCAACACGCTCAAGGTCACGGCTGGCATCTCCTTTG CCATCCCCTCAGACCGCATCACACGGTTCCTCACAGAG TTCCAAGACAAGCAGATCAAAGACTGGAAGAAGCGCT TCATCGGCATACGGATGCGGACGATCACACCAAGCCT GGTGGATGAGCTGAAGGCCAGCAACCCGGACTTCCCA GAGGTCAGCAGTGGAATTTATGTGCAAGAGGTTGCGC CGAATTCACCTTCTCAGAGAGGCGGCATCCAAGATGG TGACATCATCGTCAAGGTCAACGGGCGTCCTCTAGTGG ACTCGAGTGAGCTGCAGGAGGCCGTGCTGACCGAGTC TCCTCTCCTACTGGAGGTGCGGCGGGGGAACGACGAC CTCCTCTTCAGCATCGCCACCTGAGGTGGTCATG |
| G17476. TCGA-06-2569-01A-01R-1849-01.2 | 73101150 | 32328393 | InFrame | 8312 | ATGAGACTCCTCCCCCGCTTGCTGCTGCTTCTCTTACTC GTGTTCCCTGCCACTGTCTTGTTCCGAGGCGGCCCCAG AGGCTTGTTAGCAGTGGCACAAGATCTTACAGAGGAT GAAGAAACAGTAGAAGATTCCATAATTGAGGATGAAG ATGATGAAGCCGAGGTAGAAGAAGATGAACCCACAG ATTTG\|CACACTGTCCGTGAAGAAACGATGATGGTGAT GACTGAAGACATGCCTTTGGAAATTTCTTATGTGCCTT CTACTTATTTGACTGAAATCACTCATGTCTCACAAGCCC TATTAGAAGTGGAACAACTTCTCAATGCTCCTGACCTC TGTGCTAAGGACTTTGAAGATCTCTTTAAGCAAGAGGA GTCTCTGAAGAATATAAAAGATAGTCTACAACAAAGCT CAGGTCGGATTGACATTATTCATAGCAAGAAGACAGC AGCATTGCAAAGTGCAACGCCTGTGGAAAGGGTGAAG CTACAGGAAGCTCTCTCCCAGCTTGATTTCCAATGGGA AAAAGTTAACAAAATGTACAAGGACCGACAAGGGCGA TTTGACAGATCTGTTGAGAAATGGCGGCGTTTTCATTA TGATATAAAGATATTTAATCAGTGGCTAACAGAAGCTG AACAGTTTCTCAGAAAGACACACAATTCCTGAGAATTGG GAACATGCTAAATACAAATGGTATCTTAAGGAACTCCA GGATGGCATTGGGCAGCGGCAAACTGTTGTCAGAACA TTGAATGCAACTGGGGAAGAAATAATTCAGCAATCCTC AAAAACAGATGCCAGTATTCTACAGGAAAAATTGGGA AGCCTGAATCTGCGGTGGCAGGAGGTCTGCAAACAGC TGTCAGACAGAAAAAAGAGGCTAGAAGAACAAAAGA ATATCTTGTCAGAATTTCAAAGAGATTTAAATGAATTT GTTTTATGGTTGGAGGAAGCAGATAACATTGCTAGTAT CCCACTTGAACCTGGAAAAGAGCAGCAACTAAAAGAA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | AAGCTTGAGCAAGTCAAGTTACTGGTGGAAGAGTTGC
CCCTGCGCCAGGGAATTCTCAAACAATTAAATGAAACT
GGAGGACCCGTGCTTGTAAGTGCTCCCATAAGCCCAG
AAGAGCAAGATAAACTTGAAAATAAGCTCAAGCAGAC
AAATCTCCAGTGGATAAAGGTTTCCAGAGCTTTACCTG
AGAAACAAGGAGAAATTGAAGCTCAAATAAAAGACCT
TGGGCAGCTTGAAAAAAAGCTTGAAGACCTTGAAGAG
CAGTTAAATCATCTGCTGCTGTGGTTATCTCCTATTAGG
AATCAGTTGGAAATTTATAACCAACCAAACCAAGAAG
GACCATTTGACGTTAAGGAAACTGAAATAGCAGTTCA
AGCTAAACAACCGGATGTGGAAGAGATTTTGTCTAAA
GGGCAGCATTTGTACAAGGAAAAACCAGCCACTCAGC
CAGTGAAGAGGAAGTTAGAAGATCTGAGCTCTGAGTG
GAAGGCGGTAAACCGTTTACTTCAAGAGCTGAGGGCA
AAGCAGCCTGACCTAGCTCCTGGACTGACCACTATTGG
AGCCTCTCCTACTCAGACTGTTACTCTGGTGACACAAC
CTGTGGTTACTAAGGAAACTGCCATCTCCAAACTAGAA
ATGCCATCTTCCTTGATGTTGGAGGTACCTGCTCTGGC
AGATTTCAACCGGGCTTGGACAGAACTTACCGACTGG
CTTTCTCTGCTTGATCAAGTTATAAAATCACAGAGGGT
GATGGTGGGTGACCTTGAGGATATCAACGAGATGATC
ATCAAGCAGAAGGCAACAATGCAGGATTTGGAACAGA
GGCGTCCCCAGTTGGAAGAACTCATTACCGCTGCCCAA
AATTTGAAAAACAAGACCAGCAATCAAGAGGCTAGAA
CAATCATTACGGATCGAATTGAAAGAATTCAGAATCAG
TGGGATGAAGTACAAGAACACCTTCAGAACCGGAGGC
AACAGTTGAATGAAATGTTAAAGGATTCAACACAATG
GCTGGAAGCTAAGGAAGAAGCTGAGCAGGTCTTAGG
ACAGGCCAGAGCCAAGCTTGAGTCATGGAAGGAGGG
TCCCTATACAGTAGATGCAATCCAAAAGAAAATCACAG
AAACCAAGCAGTTGGCCAAAGACCTCCGCCAGTGGCA
GACAAATGTAGATGTGGCAAATGACTTGGCCCTGAAA
CTTCTCCGGGATTATTCTGCAGATGATACCAGAAAAGT
CCACATGATAACAGAGAATATCAATGCCTCTTGGAGAA
GCATTCATAAAAGGGTGAGTGAGCGAGAGGCTGCTTT
GGAAGAAACTCATAGATTACTGCAACAGTTCCCCCTGG
ACCTGGAAAAGTTTCTTGCCTGGCTTACAGAAGCTGAA
ACAACTGCCAATGTCCTACAGGATGCTACCCGTAAGGA
AAGGCTCCTAGAAGACTCCAAGGGAGTAAAAGAGCTG
ATGAAACAATGGCAAGACCTCCAAGGTGAAATTGAAG
CTCACACAGATGTTTATCACAACCTGGATGAAAACAGC
CAAAAAATCCTGAGATCCCTGGAAGGTTCCGATGATG
CAGTCCTGTTACAAAGACGTTTGGATAACATGAACTTC
AAGTGGAGTGAACTTCGGAAAAAGTCTCTCAACATTA
GGTCCCATTTGGAAGCCAGTTCTGACCAGTGGAAGCG
TCTGCACCTTTCTCTGCAGGAACTTCTGGTGTGGCTAC
AGCTGAAAGATGATGAATTAAGCCGGCAGGCACCTAT
TGGAGGCGACTTTCCAGCAGTTCAGAAGCAGAACGAT
GTACATAGGGCCTTCAAGAGGGAATTGAAAACTAAAG
AACCTGTAATCATGAGTACTCTTGAGACTGTACGAATA
TTTCTGACAGAGCAGCCTTTGGAAGGACTAGAGAAAC
TCTACCAGGAGCCCAGAGAGCTGCCTCCTGAGGAGAG
AGCCCAGAATGTCACTCGGCTTCTACGAAAGCAGGCT
GAGGAGGTCAATACTGAGTGGGAAAAATTGAACCTGC
ACTCCGCTGACTGGCAGAGAAAAATAGATGAGACCCT |

FIG. 27 Cont.

| sample | Gene Break-point 5p | Gene Break-point 3p | Frame Type | SEQ ID NO: | Fused Sequence |
|---|---|---|---|---|---|
| | | | | | TGAAAGACTCCGGGAACTTCAAGAGGCCACGGATGAG<br>CTGGACCTCAAGCTGCGCCAAGCTGAGGTGATCAAGG<br>GATCCTGGCAGCCCGTGGGCGATCTCCTCATTGACTCT<br>CTCCAAGATCACCTCGAGAAAGTCAAGGCACTTCGAG<br>GAGAAATTGCGCCTCTGAAAGAGAACGTGAGCCACGT<br>CAATGACCTTGCTCGCCAGCTTACCACTTTGGGCATTC<br>AGCTCTCACCGTATAACCTCAGCACTCTGGAAGACCTG<br>AACACCAGATGGAAGCTTCTGCAGGTGGCCGTCGAGG<br>ACCGAGTCAGGCAGCTGCATGAAGCCCACAGGGACTT<br>TGGTCCAGCATCTCAGCACTTTCTTTCCACGTCTGTCCA<br>GGGTCCCTGGGAGAGAGCCATCTCGCCAAACAAAGTG<br>CCCTACTATATCAACCACGAGACTCAAACAACTTGCTG<br>GGACCATCCCAAAATGACAGAGCTCTACCAGTCTTTAG<br>CTGACCTGAATAATGTCAGATTCTCAGCTTATAGGACT<br>GCCATGAAACTCCGAAGACTGCAGAAGGCCCTTTGCTT<br>GGATCTCTTGAGCCTGTCAGCTGCATGTGATGCCTTGG<br>ACCAGCACAACCTCAAGCAAAATGACCAGCCCATGGA<br>TATCCTGCAGATTATTAATTGTTTGACCACTATTTATGA<br>CCGCCTGGAGCAAGAGCACAACAATTTGGTCAACGTC<br>CCTCTCTGCGTGGATATGTGTCTGAACTGGCTGCTGAA<br>TGTTTATGATACGGGACGAACAGGGAGGATCCGTGTC<br>CTGTCTTTTAAAACTGGCATCATTTCCCTGTGTAAAGCA<br>CATTTGGAAGACAAGTACAGATACCTTTTCAAGCAAGT<br>GGCAAGTTCAACAGGATTTTGTGACCAGCGCAGGCTG<br>GGCCTCCTTCTGCATGATTCTATCCAAATTCCAAGACA<br>GTTGGGTGAAGTTGCATCCTTTGGGGGCAGTAACATT<br>GAGCCAAGTGTCCGGAGCTGCTTCCAATTTGCTAATAA<br>TAAGCCAGAGATCGAAGCGGCCCTCTTCCTAGACTGG<br>ATGAGACTGGAACCCCAGTCCATGGTGTGGCTGCCCG<br>TCCTGCACAGAGTGGCTGCTGCAGAAACTGCCAAGCA<br>TCAGGCCAAATGTAACATCTGCAAAGAGTGTCCAATCA<br>TTGGATTCAGGTACAGGAGTCTAAAGCACTTTAATTAT<br>GACATCTGCCAAAGCTGCTTTTTTTCTGGTCGAGTTGC<br>AAAAGGCCATAAAATGCACTATCCCATGGTGGAATATT<br>GCACTCCGACTACATCAGGAGAAGATGTTCGAGACTTT<br>GCCAAGGTACTAAAAAACAAATTTCGAACCAAAAGGT<br>ATTTTGCGAAGCATCCCCGAATGGGCTACCTGCCAGTG<br>CAGACTGTCTTAGAGGGGGACAACATGGAAACTCCCG<br>TTACTCTGATCAACTTCTGGCCAGTAGATTCTGCGCCTG<br>CCTCGTCCCCTCAGCTTTCACACGATGATACTCATTCAC<br>GCATTGAACATTATGCTAGCAGGCTAGCAGAAATGGA<br>AAACAGCAATGGATCTTATCTAAATGATAGCATCTCTC<br>CTAATGAGAGCATAGATGATGAACATTTGTTAATCCAG<br>CATTACTGCCAAAGTTTGAACCAGGACTCCCCCCTGAG<br>CCAGCCTCGTAGTCCTGCCCAGATCTTGATTTCCTTAGA<br>GAGTGAGGAAAGAGGGGAGCTAGAGAGAATCCTAGC<br>AGATCTTGAGGAAGAAAACAGGAATCTGCAAGCAGAA<br>TATGACCGTCTAAAGCAGCAGCACGAACATAAAGGCC<br>TGTCCCCACTGCCGTCCCCTCCTGAAATGATGCCCACCT<br>CTCCCCAGAGTCCCCGGGATGCTGAGCTCATTGCTGAG<br>GCCAAGCTACTGCGTCAACACAAAGGCCGCCTGGAAG<br>CCAGGATGCAAATCCTGGAAGACCACAATAAACAGCT<br>GGAGTCACAGTTACACAGGCTAAGGCAGCTGCTGGAG<br>CAACCCCAGGCAGAGGCCAAAGTGAATGGCACAACG<br>GTGTCCTCTCCTTCTACCTCTCTACAGAGGTCCGACAGC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | AGTCAGCCTATGCTGCTCCGAGTGGTTGGCAGTCAAAC TTCGGACTCCATGGGTGAGGAAGATCTTCTCAGTCCTC CCCAGGACACAAGCACAGGGTTAGAGGAGGTGATGG AGCAACTCAACAACTCCTTCCCTAGTTCAAGAGGAAGA AATACCCCTGGAAAGCCAATGAGAGAGGACACAATG |
| G17195. TCGA-06-0138-01A-02R-1849-01.2 | 69145970 | 58109543 | InFrame | 8313 | ATGCCACTCCTGGGTCAGACGGTGAGGTCGGCGTCTG CGAGGACGCGGCGGTGGAGTAGAAGGGCAGCCGGA GACAGGCCCGGCGCCCCTTCCGAGGCTAGACGGCCCC AGCTTCGCGGGGATCATGGCATTGTGGACCGAGTGCG GGGCCACTGGCGAATCGCCGGCTCCTGTTCAACCTGCT GGTGTCCATCTGCATTGTGTTCCTCAACAAATGGATTT ATGTGTACCTTCCCCAACATGAGCCTGACCCTGGTGCA CTTCGTGGTCACCTGGCTGGGCTTGTATATCTGCCAGA AGCTGGACATCTTTGCCCCCAAAAGTCTGCCGCCCTCC AGGCTCCTCCTCCTGGCCCTCAGCTTCTGTGGCTTTGTG GTCTTCACTAACCTTTCTCTGCAGAACAACACCATAGG CACCTATCAGCTGGCCAAGGCCATGACCACGCCGGTG ATCATAGCCATCCAGACCTTCTGCTACCAGAAAACCTT CTCCACCAGAATCCAGCTCACGCTGATTCCTATAACTTT AGGTGTAATCCTAAATTCTTATTACGATGTGAAGTTTA ATTTCCTTGGAATGGTGTTTGCTGCTCTTGGTGTTTTAG TTACATCCCTTTATCAAGTGTGGGTAGGAGCCAAACAG CATGAATTACAAGTGAACTCAATGCAGCTGCTGTACTA CCAGGCTCCGATGTCATCTGCCATGTTGCTGGTTGCTG TGCCCTTCTTTGAGCCAGTGTTTGGAGAAGGAGGAAT ATTTGGTCCCTGGTCAGTTTCTGCTTTG\|TTCCTCTGTG ACGAGGGTGCAGGTATCTCTGGGGACTACATCGATCG CGTGGACGAGCCCTTGTCCTGCTCTTATGTGCTGACCA TTCGCACTCCTCGGCTCTGCCCCCACCCTCTCCTCCGGC CCCCACCCAGTGCTGCACCGCAGGCCATCCTCTGTCAC CCTTCCCTACAGCCTGAGGAGTACATGGCCTACGTTCA GAGGCAAGCCGACTCAAAGCAGTATGGAGATAAAATC ATAGAGGAGCTGCAAGATCTAGGCCCCCAAGTGTGGA GTGAGACCAAGTCTGGGGTGGCACCCCAAAAGATGGC AGGTGCGAGCCCGACCAAGGATGACAGTAAGGACTCA GATTTCTGGAAGATGCTTAATGAGCCAGAGGACCAGG CCCCAGGAGGGGAGGAGGTGCCGGCTGAGGAGCAGG ACCCAAGCCCTGAGGCAGCAGATTCAGCTTCTGGTGCT CCCAATGATTTTCAGAACAACGTGCAGGTCAAAGTCAT TCGAAGCCCTGCGGATTTGATTCGATTCATAGAGGAGC TGAAAGGTGGAACAAAAAAGGGGAAGCCAAATATAG GCCAAGAGCAGCCTGTGGATGATGCTGCAGAAGTCCC TCAGAGGGAACCAGAGAAGGAAAGGGGTGATCCAGA ACGGCagagagagatggaagaagaggaggatgaggatgaggatg aggatgaagatgaggatgaACGGCAGTTACTGGGAGAATTT GAGAAGGAACTGGAAGGGATCCTGCTTCCGTCAGACC GAGACCGGCTCCGTTCGGAGGTGAAGGCTGGCATGG AGCGGGAACTGGAAAACATCATCCAGGAGACAGAGA AAGAGCTGGACCCAGATGGGCTGAAGAAGGAGTCAG AGCGGGATCGGGCAATGCTGGCTCTCACATCCACTCTC AACAAACTCATCAAAAGACTGGAGGAAAAACAGAGTC CAGAGCTGGTGAAGAAGCACAAGAAAAAGAGGGTTG TCCCCAAAAAGCCTCCCCCATCACCCCAACCTACAGAG GAGGATCCTGAGCACAGAGTCCGGGTCGGGTCACCA AGCTCCGTCTCGGAGGCCCTAATCAGGATCTGACTGTC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CTCGAGATGAAACGGGAAAACCCACAGCTGAAACAAA TCGAGGGGCTGGTGAAGGAGCTGCTGGAGAGGGAGG GACTCACAGCTGCAGGGAAAATTGAGATCAAAATTGT CCGCCCATGGGCTGAAGGGACTGAAGAGGGTGCACG TTGGCTGACTGATGAGGACACGAGAAACCTCAAGGAG ATCTTCTTCAATATCTTGGTGCCGGGAGCTGAAGAGGC CCAGAAGGAACGCCAGCGGCAGAAAGAGCTGGAGAG CAATTACCGCCGGGTGTGGGGCTCTCCAGGTGGGGAG GGCACAGGGGACCTGGACGAATTTGACTTC |
| G17212. TCGA-06-0129-01A-01R-1849-01.2 | 140858113 | 163956014 | InFrame | 8314 | ATGGTCCCAGAGGCCTGGAGGAGCGGACTGGTAAGC ACCGGGAGGGTAGTGGGAGTTTTGCTTCTGCTTGGTG CCTTGAACAAGGCTTCCACGGTCATTCACTATGAGATC CCGGAGGAAAGAGAGAAGGGTTTCGCTGTGGGCAAC GTGGTCGCGAACCTTGGTTTGGATCTCGGTAGCCTCTC AGCCCGCAGGTTCCGGGTGGTGTCTGGAGCTAGCCGA AGATTCTTTGAGGTGAACCGGGAGACCGGAGAGATGT TTGTGAACGACCGTCTGGATCGAGAGGAGCTGTGTGG GACACTGCCCTCTTGCACTGTAACTCTGGAGTTGGTAG TGGAGAACCCGCTGGAGCTGTTCAGCGTGGAAGTGGT GATCCAGGACATCAACGACAACAATCCTGCTTTCCCTA CCCAGGAAATGAAATTGGAGATTAGCGAGGCCGTGGC TCCGGGGACGCGCTTTCCGCTCGAGAGCGCGCACGAT CCCGATGTGGGAAGCAACTCTTTACAAACCTATGAGCT GAGCCGAAATGAATACTTTGCGCTTCGCGTGCAGACG CGGGAGGACAGCACCAAGTACGCGGAGCTGGTGTTG GAGCGCGCCCTGGACCGAGAACGGGAGCCTAGTCTCC AGTTAGTGCTGACGGCGTTGGACGGAGGGACCCCAGC TCTCTCCGCCAGCCTGCCTATTCACATCAAGGTGCTGG ACGCGAATGACAATGCGCCTGTCTTCAACCAGTCCTTG TACCGGGCGCGCGTCCTGGAGGATGCACCCTCCGGCA CGCGCGTGGTACAAGTCCTTGCAACGGATCTGGATGA AGGCCCCAACGGTGAAATTATTTACTCCTTCGGCAGCC ACAACCGCGCCGGCGTGCGGCAACTATTCGCCTTAGA CCTTGTAACCGGGATGCTGACAATCAAGGGTCGGCTG GACTTCGAGGACACCAAACTCCATGAGATTTACATCCA GGCCAAAGACAAGGGCGCCAATCCCGAAGGAGCACA TTGCAAAGTGTTGGTGGAGGTTGTGGATGTGAATGAC AACGCCCCGGAGATCACAGTCACCTCCGTGTACAGCCC AGTACCCGAGGATGCCCCTCTGGGGACTGTCATCGCTT TGCTCAGTGTGACTGACCTGGATGCTGGCGAGAACGG GCTGGTGACCTGCGAAGTTCCACCGGGTCTCCCTTTCA GCCTTACTTCTTCCCTCAAGAATTACTTCACTTTGAAAA CCAGTGCAGACCTGGATCGGGAGACTGTGCCAGAATA CAACCTCAGCATCACCGCCCGAGACGCCGGAACCCCTT CCCTCTCAGCCCTTACAATAGTGCGTGTTCAAGTGTCC GACATCAATGACAACCCTCCACAATCTTCTCAATCTTCC TACGACGTTTACATTGAAGAAAACAACCTCCCCGGGGC TCCAATACTAAACCTAAGTGTCTGGGACCCCGACGCCC CGCAGAATGCTCGGCTTTCTTTCTTTCTCTTGGAGCAA GGAGCTGAAACCGGGCTAGTGGGTCGCTATTTCACAA TAAATCGTGACAATGGCATAGTGTCATCCTTAGTGCCC CTAGACTATGAGGATCGGCGGGAATTTGAATTAACAG CTCATATCAGCGATGGGGGCACCCCGGTCCTAGCCACC AACATCAGCGTGAACATATTTGTCACTGATCGCAATGA CAATGCCCCCAGGTCCTATATCCTCGGCCAGGTGGGA |

FIG. 27 Cont.

| sample | Gene Break point 5p | Gene Break point 3p | Frame Type | SEQ ID NO: | Fused Sequence |
|---|---|---|---|---|---|
| | | | | | GCTCGGTGGAGATGCTGCCTCGAGGTACCTCAGCTGG CCACCTAGTGTCACGGGTGGTAGGCTGGGACGCGGAT GCAGGGCACAATGCCTGGCTCTCCTACAGTCTCTTGGG ATCCCCTAACCAGAGCCTTTTTGCCATAGGGCTGCACA CTGGTCAAATCAGTACTGCCCGTCCAGTCCAAGACACA GATTCACCCAGGCAGACTCTCACGGTCTTGATCAAAGA CAATGGGGAGCCTTCGCTCTCCACCACTGCTACCCTCA CTGTGTCAGTAACCGAGGACTCTCCTGAAGCCCGAGCC GAGTTCCCCTCTGGCTCTGCCCCCCGGGAGCAGAAAA AAAATCTCACCTTTTATCTACTTCTTTCTCTAATCCTGGT TTCTGTGGGGTTTGTGGTCACAGTGTTCGGAGTAATCA TATTCAAAGTTTACAAGTGGAAGCAGTCTAGAGACCTA TACCGAGCCCCGGTGAGCTCACTGTACCGAACACCAG GGCCCTCCTTGCACGCGGACGCCGTGCGGGAGGCCT GATGTCGCCGCACCTTTACCATCAGGTGTATCTCACCA CGGACTCCCGCCGCAGCGACCCGCTGCTGAAGAAACC TGGTGCAGCCAGTCCACTGGCCAGCCGCCAGAACACG CTGCGGAGCTGTGATCCGGTGTTCTATAGGCAGGTGT TGGGTGCAGAGAGCGCCCCTCCCGGACAG\|GAGGAG CAAAATAGAGGCAAGCCCAATTGGGAGCATCTAAATG AAGATTTACATGTACTAATCACTGTGGAAGATGCTCAG AACAGAGCAGAAATCAAATTGAAGAGAGCAGTTGAAG AAGTGAAGAAATTATTGGTACCTGCAGCAGAAGGAGA AGACAGCCTGAAGAAGATGCAGCTGATGGAGCTTGCG ATTCTGAATGGCACCTACAGAGATGCCAACATTAAATC ACCAGCCCTTGCCTTTTCTCTTGCAGCAACAGCCCAGG CTGCTCCAAGGATCATTACTGGGCCTGCGCCGGTTCTC CCACCAGCTGCCCTGCGTACTCCTACGCCAGCTGGCCC TACCATAATGCCTTTGATCAGACAAATACAGACCGCTG TCATGCCAAACGGAACTCCTCACCCAACTGCTGCAATA GTTCCTCCAGGGCCCGAAGCTGGTTTAATCTATACACC CTATGAGTACCCCTACACATTGGCACCAGCTACATCAA TCCTTGAGTATCCTATTGAACCTAGTGGTGTATTAGGT GCGGTGGCTACTAAAGTTCGAAGGCACGATATGCGTG TCCATCCTTACCAAAGGATTGTGACCGCAGACCGAGCC GCCACCGGCAAC |
| G17213. TCGA-06-0157-01A-01R-1849-01.2 | 2062889 | 90075838 | InFrame | 8315 | ATGGCGGACATCGAGCAGTACTACATGAAGCCGCCCG \|AGATCGTTAAGGAGGCTGAGGTGCCGCAGGCTGCGC TGGGCGTCCCAGCCCAGGGGACAGGGGACAATGGCC ACACGCCTGTGGAGGAGGAGGTCGGGGGCATCCCAG TACCAGCACCGGGGCTCCTGCAGGTCACGGAGAGGAG GCAGCCTCTGAGCAGCGTCTCCTCTCTGGAGGTCCACT TCGACCTCCTGGACCTCACTGAGCTCACCGACATGTCG GACCAGGAGCTGGCCGAGGTCTTTGCTGACTCGGACG ACGAGAACCTCAACACCGAGTCCCCAGCAGGTCTGCA CCCGCTGCCCCGGGCCGGCTACCTGCGCTCCCCTTCCT GGACGAGGACAAGGGCTGAGCAGAGCCACGAGAAGC AGCCCCTAGGCGACCCCGAGCGGCAGGCCACAGTCCT GGACACGTTTCTCACTGTGGAGAGGCCCCAGGAGGAC |
| G17200. TCGA-06-0125-01A-01R-1849-01.2 | 27094490 | 24624366 | InFrame | 8316 | ATGGCCGCGCAGGTCGCCCCCGCCGCCGCCAGCAGCC TGGGCAACCCGCCGCCGCCGCCGCCCCTCGGAGCTGAA GAAAGCCGAgcagcagcagcagcgggaggaggcggggggcgaggcg gcggcggcggcagcggcCGAGCGCGGGGAAATGAAGGCA GCCGCCGGGCAGGAAAGCGAGGGCCCCGCCGTGGGG CCGCCGCAGCCGCTGGGAAAGGAGCTGCAGGACGGG |

FIG. 27 Cont.

| sample | Gene Break-point 5p | Gene Break-point 3p | Frame Type | SEQ ID NO: | Fused Sequence |
|---|---|---|---|---|---|
| | | | | | GCCGAGAGCAATGGGggtggcggcggcggcggagccggcagc ggcggcggGCCCGGCGCGGAGCCGGACCTGAAGAACTC GAACGGGAACGCGGGCCCTAGGCCCGCCCTGAACAAT AACCTCACGGAGCCGCCcggcggcggcggtggcggcagcagc gatggggtgggggcgCCTCCTCACTCAGCCGCGGCCGCCTT GCCGCCCCAGCCTACGGCTTCGGGCAACCCTACGGCC GGAGCCCGTCTGCCGTCGCCGCCGCGCGGCCGCCGT CTTCCACCAACAACATGGCGGACAACAAAGCCCTGGC CTGGCAGCGCTGCAGAGCGGCGGCGGCGGGGGCCTG GAGCCCTACGCGGGGCCCCAGCAGAACTCTCACGACC ACGGCTTCCCCAACCACCAGTACAACTCCTACTACCCC AACCGCAGCGCCTACCCCCCGCCCGCCCCGGCCTACGC GCTGAGCTCCCCGAGAGGTGGCACTCCGGGCTCCGGC GCGGCGGCGGCTGCCGGCTCCAAGCCGCCTCCCTCCTC CAGCGCCTCCGCCTCCTCGTCGTCTTCGTCCTTCGCTCA GCAGCGCTTCGGGGCCATGGGGGGAGGCGGCCCCTC CGCGGCCGGCGGGGGAACTCCCCAGCCCACCGCCACC CCCACCCTCAACCAACTGCTCACGTCGCCCAGCTCGGC CCGGGGCTACCAGGGCTACCCCGGGGGCGACTACAGT GGCGGGCCCCAGGACGGGGGCGCCGGCAAGGGCCCG GCGGACATGGCCTCGCAGTGTTGGGGggctgcggcggcgg cagctgcggcggcggcCGCCTCGGGAGGGGCCCAACAAAG GAGCCACCACGCGCCCATGAGCCCCGGGAGCAGCGGC GGCGGGGGGCAGCCGCTCGCCCGGACCCCTCAGCCAT CCAGTCCAATGGATCAGATGGGCAAGATGAGACCTCA GCCATATGGCGGGACTAACCCATACTCGCAGCAACAG GGACCTCCGTCAGGACCGCAGCAAGGACATGGGTACC CAGGGCAGCCATACGGGTCCCAGACCCCGCAGCGGTA CCCGATGACCATGCAGGGCCGGGCGCAGAGTGCCATG GGCGGCCTCTCTTATACACAGCAGATTCCTCCTTATGG ACAACAAGGCCCCAGCGGGTATGGTCAACAGGGCCAG ACTCCATATTACAACCAGCAAAGTCCTCACCCTCAGCA GCAGCAGCCACCCTACTCCCAGCAACCACCGTCCCAGA CCCCTCATGCCCAACCTTCGTATCAGCAGCAGCCACAG TCTCAACCACCACAGCTCCAGTCCTCTCAGCCTCCATAC TCCCAGCAGCCATCCCAGCCTCCACATCAGCAGTCCCC GGCTCCATACCCCTCCCAGCAGTCGACGACACAGCAGC ACCCCAGAGCCAGCCCCCCTACTCACAGCCACAGGCT CAGTCTCCTTACCAGCAGCAGCAACCTCAGCAGCCAGC ACCCTCGACGCTCTCCCAGCAGGCTGCGTATCCTCAGC CCCAGTCTCAGCAGTCCCAGCAAACTGCCTATTCCCAG CAGCGCTTCCCTCCACCGCAGGAGCTATCTCAAGATTC ATTTGGGTCTCAGGCATCCTCAGCCCCCTCAATGACCT CCAGTAAGGGAGGGCAAGAAGATATGAACCTGAGCCT TCAGTCAAGACCCTCCAGCTTGCCTGATCTATCTGGTTC AATAGATGACCTCCCCATGGGGACAGAAGGAGCTCTG AGTCCTGGAGTGAGCACATCAGGGATTTCCAGCAGCC AAGGAGAGCAGAGTAATCCAGCTCAGTCTCCTTTCTCT CCTCATACCTCCCCTCACCTGCCTGGCATCCGAGGCCCT TCCCCGTCCCTGTTGGCTCTCCCGCCAGTGTTGCTCAG TCTCGCTCAGGACCACTCTCGCCTGCTGCAGTGCCAGG CAACCAGATGCCACCTCGGCCACCCAGTGGCCAGTCG GACAGCATCATGCATCCTTCCATGAACCAATCAAGCAT TGCCCAAGATCGAGGTTATATGCAGAGGAACCCCCAG ATGCCCCAGTACAGTTCCCCCCAGCCCGGCTCAGCCTT |

FIG. 27 Cont.

| sample | Gene Break-point 5p | Gene Break-point 3p | Frame Type | SEQ ID NO: | Fused Sequence |
|---|---|---|---|---|---|
| | | | | | ATCTCCGCGTCAGCCTTCCGGAGGACAGATACACACA GGCATGGGCTCCTACCAGCAGAACTCCATGGGGAGCT ATGGTCCCCAGGGGGGTCAGTATGGCCCACAAGGTGG CTACCCCAGGCAGCCAAACTATAATGCCTTGCCCAATG CCAACTACCCCAGTGCAGGCATGGCTGGAGGCATAAA CCCCATGGGTGCCGGAGGTCAAATGCATGGACAGCCT GGCATCCCACCTTATGGCACACTCCCTCCAGGGAGGAT GAGTCACGCCTCCATGGGCAACCGGCCTTATGGCCCTA ACATGGCCAATATGCCACCTCAGGTTGGGTCAGGGAT GTGTCCCCACCAGGGGGCATGAACCGGAAAACCCAA GAAACTGCTGTCGCCATGCATGTTGCTGCCAACTCTAT CCAAAACAGGCCGCCAGGCTACCCCAATATGAATCAA GGGGGCATGATGGGAACTGGACCTCCTTATGGACAAG GGATTAATAGTATGGCTGGCATGATCAACCCTCAGGG ACCCCATATTCCATGGGTGGAACCATGGCCAACAATT CTGCAGGGATGGCAGCCAGCCCAGAGATGATGGGCCT TGGGGATGTAAAGTTAACTCCAGCCACCAAAATGAAC AACAAGGCAGATGGGACACCCAAGACAGAATCCAAAT CCAAGAAATCCAGTTCTTCTACTACAACCAATGAGAAG ATCACCAAGTTGTATGAGCTGGGTGGTGAGCCTGAGA GGAAGATGTGGGTGGACCGTTATCTGGCCTTCACTGA GGAGAAGGCCATGGGCATGACAAATCTGCCTGCTGTG GGTAGGAAACCTCTGGACCTCTATCGCCTCTATGTGTC TGTGAAGGAGATTGGTGGATTGACTCAG\|ATGCAGGC CCTGACTTCCTGTGAGTGCACCATCTGTCCTGACTGCTT CCGCCAGCACTTCACCATCGCCTTGAAGGAGAAGCAC ATCACAGACATGGTGTGCCCTGCCTGTGGCCGCCCCGA CCTCACCGATGACACACAGTTGCTCAGCTACTTCTCTAC CCTTGACATCCAGCTTCGCGAGAGCCTAGAGCCAGAT GCCTATGCGTTGTTCCATAAGAAGCTGACCGAGGGTG TGCTGATGCGGGACCCCAAGTTCTTGTGGTGTGCCCAG TGCTCCTTTGGCTTCATATATGAGCGTGAGCAGCTGGA GGCAACTTGTCCCCAGTGTCACCAGACCTTCTGTGTGC GCTGCAAGCGCCAGTGGGAGGAGCAGCACCGAGGTC GGAGCTGTGAGGACTTCCAGAACTGGAAACGCATGAA CGACCCAGAATACCAGGCCCAGGGCCTAGCAATGTAT CTTCAGGAAAACGGCATTGACTGCCCCAAATGCAAGTT CTCGTACGCCCTGGCCCGAGGAGGCTGCATGCACTTTC ACTGTACCCAGTGCCGCCACCAGTTCTGCAGCGGCTGC TACAATGCCTTTTACGCCAAGAATAAATGTCCAGAGCC TAACTGCAGGGTGAAAAAGTCCCTGCACGGCCACCAC CCTCGAGACTGCCTCTTCTACCTGCGGGACTGGACTGC TCTCCGGCTTCAGAAGCTGCTACAGGACAATAACGTCA TGTTTAATACAGAGCCTCCAGCTGGGGCCCGGGCAGT CCCTGGAGGCGGCTGCCGAGTGATAGAGCAGAAGGA GGTTCCCAATGGGCTCAGGGACGAAGCTTGTGGCAAG GAAACTCCAGCTGGCTATGCCGGCCTGTGCCAGGCAC ACTACAAAGAGTATCTTGTGAGCCTCATCAATGCCCAC TCGCTGGACCCAGCCACCTTGTATGAGGTGGAAGAGC TGGAGACGGCCACTGAGCGCTACCTGCACGTACGCCC CCAGCCTTTGGCTGGAGAGGATCCCCCTGCTTACCAGG CCCGCTTGTTACAGAAGCTGACAGAAGAGGTACCCTT GGGACAGAGTATCCCCCGCAGGCGGAAG |
| G17804. TCGA-06- | 55268105 | 56079562 | InFrame | 8317 | ATGCGACCCTCCGGGACGGCCGGGGCAGCGCTCCTGG CGCTGCTGGCTGCGCTCTGCCCGGCGAGTCGGGCTCT |

FIG. 27 Cont.

| sample | Gene Break-point 5p | Gene Break-point 3p | Frame Type | SEQ ID NO: | Fused Sequence |
|---|---|---|---|---|---|
| 5408-01A-01R-1849-01.4 | | | | | GGAGGAAAAGAAAGTTTGCCAAGGCACGAGTAACAAGCTCACGCAGTTGGGCACTTTTGAAGATCATTTTCTCAGCCTCCAGAGGATGTTCAATAACTGTGAGGTGGTCCTTGGGAATTTGGAAATTACCTATGTGCAGAGGAATTATGATCTTTCCTTCTTAAAGACCATCCAGGAGGTGGCTGGTTATGTCCTCATTGCCCTCAACACAGTGGAGCGAATTCCTTTGGAAAACCTGCAGATCATCAGAGGAAATATGTACTACGAAAATTCCTATGCCTTAGCAGTCTTATCTAACTATGATGCAAATAAAACCGGACTGAAGGAGCTGCCCATGAGAAATTTACAGGAAATCCTGCATGGCGCCGTGCGGTTCAGCAACAACCCTGCCCTGTGCAACGTGGAGAGCATCCAGTGGCGGGACATAGTCAGCAGTGACTTTCTCAGCAACATGTCGATGGACTTCCAGAACCACCTGGGCAGCTGCCAAAAGTGTGATCCAAGCTGTCCCAATGGGAGCTGCTGGGGTGCAGGAGAGGAGAACTGCCAGAAACTGACCAAAATCATCTGTGCCCAGCAGTGCTCCGGGCGCTGCCGTGGCAAGTCCCCAGTGACTGCTGCCACAACCAGTGTGCTGCAGGCTGCACAGGCCCCCGGGAGAGCGACTGCCTGGTCTGCCGCAAATTCCGAGACGAAGCCACGTGCAAGGACACCTGCCCCCCACTCATGCTCTACAACCCCACCACGTACCAGATGGATGTGAACCCCGAGGGCAAATACAGCTTTGGTGCCACCTGCGTGAAGAAGTGTCCCCGTAATTATGTGGTGACAGATCACGGCTCGTGCGTCCGAGCCTGTGGGGCCGACAGCTATGAGATGGAGGAAGACGGCGTCCGCAAGTGTAAGAAGTGCGAAGGGCCTTGCCGCAAAGTGTGTAACGGAATAGGTATTGGTGAATTTAAAGACTCACTCTCCATAAATGCTACGAATATTAAACACTTCAAAAACTGCACCTCCATCAGTGGCGATCTCCACATCCTGCCGGTGGCATTTAGGGGTGACTCCTTCACACATACTCCTCCTCTGGATCCACAGGAACTGGATATTCTGAAAACCGTAAAGGAAATCACAGGGTTTTTGCTGATTCAGGCTTGGCCTGAAAACAGGACGGACCTCCATGCCTTTGAGAACCTAGAAATCATACGCGGCAGGACCAAGCAACATGGTCAGTTTTCTCTTGCAGTCGTCAGCCTGAACATAACATCCTTGGGATTACGCTCCCTCAAGGAGATAAGTGATGGAGATGTGATAATTTCAGGAAACAAAAATTTGTGCTATGCAAATACAATAAACTGGAAAAAACTGTTTGGGACCTCCGGTCAGAAAACCAAAATTATAAGCAACAGAGGTGAAAACAGCTGCAAGGCCACAGGCCAGGTCTGCCATGCCTTGTGCTCCCCCGAGGGCTGCTGGGGCCCGGAGCCCAGGGACTGCGTCTCTTGCCGGAATGTCAGCCGAGGCAGGGAATGCGTGGACAAGTGCAACCTTCTGGAGGGTGAGCCAAGGGAGTTTGTGGAGAACTCTGAGTGCATACAGTGCCACCCAGAGTGCCTGCCTCAGGCCATGAACATCACCTGCACAGGACGGGGACCAGACAACTGTATCCAGTGTGCCCACTACATTGACGGCCCCCACTGCGTCAAGACCTGCCCGGCAGGAGTCATGGGAGAAAACAACACCCTGGTCTGGAAGTACGCAGACGCCGGCCATGTGTGCCACCTGTGCCATCCAAACTGCACCTACGGATGCACTGGGCCAGGTCTTGAAGGCTGTCCAACGAATGGGCCTAAGATCCCGTCCATCGCCACTGGGATGGTGGGGGCCCTCCTCTTGCTGCTGGTGGTGGCCCTGGGGATCGGCCTCTTCATGCGAAGGCGCCACATCGTTCGGAAGCGCACGCTGCGGAGGCTGCTCCAGGAGAGGGAGCTTGTGGAGCCTCTTACACCCAGTGGAGAAGCTCCCAACCAAGCTCTCTTGAGGATCTTGAAGGAAACTG |

FIG. 27 Cont.

| sample | Gene Break point 5p | Gene Break point 3p | Frame Type | SEQ ID NO: | Fused Sequence |
|---|---|---|---|---|---|
| | | | | | AATTCAAAAAGATCAAAGTGCTGGGCTCCGGTGCGTT CGGCACGGTGTATAAGGGACTCTGGATCCCAGAAGGT GAGAAAGTTAAAATTCCCGTCGCTATCAAGGAATTAA GAGAAGCAACATCTCCGAAAGCCAACAAGGAAATCCT CGATGAAGCCTACGTGATGGCCAGCGTGGACAACCCC CACGTGTGCCGCCTGCTGGGCATCTGCCTCACCTCCAC CGTGCAGCTCATCACGCAGCTCATGCCCTTCGGCTGCC TCCTGGACTATGTCCGGGAACACAAAGACAATATTGG CTCCCAGTACCTGCTCAACTGGTGTGTGCAGATCGCAA AGGGCATGAACTACTTGGAGGACCGTCGCTTGGTGCA CCGCGACCTGGCAGCCAGGAACGTACTGGTGAAAACA CCGCAGCATGTCAAGATCACAGATTTTGGGCTGGCCA AACTGCTGGGTGCGGAAGAGAAAGAATACCATGCAG AAGGAGGCAAAGTGCCTATCAAGTGGATGGCATTGGA ATCAATTTTACACAGAATCTATACCCACCAGAGTGATG TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|GATGCT TTCATTGGATTTGGAGGAAATGTGATCAGGCAACAAG TCAAGGATAACGCCAAATGGTATATCACTGATTTTGTA GAGCTGCTGGGAGAACTGGAAGAA |
| G17656. TCGA-28- 2514- 01A-02R- 1850- 01.2 | 27024031 | 49202124 | inFrame | 8318 | ATGGCCGCGCAGGTCGCCCCCGCCGCCGCCAGCAGCC TGGGCAACCCGCCGCCGCCGCCGCCCTCGGAGCTGAA GAAAGCCGAgcagcagcagcagcgggaggaggcggggggcgaggcg gcggcggcggcagcggCGAGCGCGGGGAAATGAAGGCA GCCGCCGGGCAGGAAAGCGAGGGCCCCGCCGTGGGG CCGCCGCAGCCGCTGGGAAAGGAGCTGCAGGACGGG GCCGAGAGCAATGGGggtggcggcggcggcggagccggcagc ggcggcggGCCCGGCGCGGAGCCGGACCTGAAGAACTC GAACGGGAACGCGGGCCCTAGGCCCGCCCTGAACAAT AACCTCACGGAGCCGCCCggcggcggcggtggcggcagcagc gatggggtgggggcgCCTCCTCACTCAGCCGCGGCCGCCTT GCCGCCCCAGCCTACGGCTTCGGGCAACCCTACGGCC GGAGCCCGTCTGCCGTCGCCGCCGCCGCGGCCGCCGT CTTCCACCAACAACATGGCGGACAACAAAGCCCTGGC CTGGCAGCGCTGCAGAGCGGCGGCGGCGGGGGCCTG GAGCCCTACGCGGGGCCCCAGCAGAACTCTCACGACC ACGGCTTCCCCAACCACCAGTACAACTCCTACTACCCC AACCGCAGCGCCTACCCCCCGCCCGCCCCCGGCCTACGC GCTGAGCTCCCCGAGAGGTGGCACTCCGGGCTCCGGC GCGGCGGCGGCTGCCGGCTCCAAGCCGCCTCCCTCCTC CAGCGCCTCCGCCTCCTCGTCGTCTTCGTCCTTCGCTCA GCAGCGCTTCGGGGCCATGGGGGAGGCGGCCCCTC CGCGGCCGGCGGGGGAACTCCCCAGCCCACCGCCACC CCCACCCTCAACCAACTGCTCACGTCGCCCAGCTCGGC CCGGGGCTACCAGGGCTACCCCGGGGGCGACTACAGT GGCGGGCCCAGGACGGGGGCGCCGGCAAGGGCCCG GCGGACATGGCCTCGCAGTGTTGGGGggctgcggcggcgg cagctgcggcggcggcCGCCTCGGGAGGGGCCCAACAAAG GAGCCACCACGCGCCCATGAGCCCCGGGAGCAGCGGC GGCGGGGGGCAGCCGCTCGCCCGGACCCCTCAG\|GTC |

FIG. 27 Cont.

| sample | Gene Break-point 5p | Gene Break-point 3p | Frame Type | SEQ ID NO: | Fused Sequence |
|---|---|---|---|---|---|
| | | | | | CATCTGGGAAGCGGGATTTGGGTTGATGAGGAGAAAT<br>GGCACCAGCTACAAGTAACCCAAGGAGATTCCAAGTA<br>CACGAAGAACTTGGCAGTTATGATTTGGGGAACAGAT<br>GTTCTGAAAAACAGAAGCGTCACAGGCGTCGCCACAA<br>AAAAAAAGAAAGATGCAGTCCCTAAACCACCCCTCTCG<br>CCTCACAAACTAAGCATCGTCAGAGAGTGTTTGTATGA<br>CAGAATAGCACAAGAAACTGTGGATGAAACTGAAATT<br>GCACAGAGACTCTCCAAAGTCAACAAGTACATCTGTGA<br>AAAAATCATGGATATCAATAAATCCTGTAAAAATGAAG<br>AACGAAGGGAAGCAAAATACAATTTGCAA |
| G17654.<br>TCGA-41-<br>4097-<br>01A-01R-<br>1850-<br>01.2 | 146017814 | 156294880 | InFrame | 8319 | ATGCTTCTCTCGTTACCTGCCTTACATCTTCAGACCTCC<br>GAACACCATCCTTTCTTCCAGCTGCCACACAGAAGGCT<br>CGGACCATGGTGCAGTCCCACTGGCTCCCCTGCCCCCC<br>TCTCCTGTGAGACTGGCTGCGGGGAGGGATCATGGAT<br>ACTTGTCTGCCGGCTTCTGGTTCCCACGCAAGTAAGCC<br>TGCTGTCAATGGAGGAGGACATTGATACCCGCAAAAT<br>CAACAACAGTTTCCTGCGCGACCACAGCTATGCGACCG<br>AAGCTGACATTATCTCTACGGTAGAATTCAACCACACG<br>GGAGAATTACTAGCGACAGGGGACAAGGGGGGTCGG<br>GTTGTAATATTTCAACGAGAGCAGGAGAGTAAAAATC<br>AGGTTCATCGTAGGGGTGAATACAATGTTTACAGCAC<br>ATTCCAGAGCCATGAACCCGAGTTCGATTACCTGAAGA<br>GTTTAGAAATAGAAGAAAAAATCAATAAAATAAGATG<br>GCTCCCCCAGCAGAATGCAGCTTACTTTCTTCTGTCTAC<br>TAATGATAAAACTGTGAAGCTGTGGAAAGTCAGCGAG<br>CGTGATAAGAGGCCAGAAGGCTACAATCTGAAAGATG<br>AGGAGGGCCGGCTCCGGGATCCTGCCACCATCACAAC<br>CCTGCGGGTGCCTGTCCTGAGACCCATGGACCTGATG<br>GTGGAGGCCACCCCACGAAGAGTATTTGCCAACGCAC<br>ACACATATCACATCAACTCCATATCTGTCAACAGCGAC<br>TATGAAACCTACATGTCCGCTGATGACCTGAGGATTAA<br>CCTATGGAACTTTGAAATAACCAATCAAAGTTTTAATA<br>TTGTGGACATTAAGCCAGCCAACATGGAGGAGCTCAC<br>GGAGGTGATCACAGCAGCCGAGTTCCACCCCCATCATT<br>GCAACACCTTCGTGTACAGCAGCAGCAAAGGGACAAT<br>CCGGCTGTGTGACATGCGGGCATCTGCCCTGTGTGAC<br>AGGCACACCAAAT\|CAGGGGAAATGCTGTCTGTAGCT<br>GAGCACTTCCTGGAGCAGCAGATGCACCCAACAGTGG<br>TGATCAGTGCTTACCGCAAGGCATTGGATGATATGATC<br>AGCACCCTAAAGAAAATAAGTATCCCAGTCGACATCAG<br>TGACAGTGATATGATGCTGAACATCATCAACAGCTCTA<br>TTACTACCAAAGCCATCAGTCGGTGGTCATCTTTGGCT<br>TGCAACATTGCCCTGGATGCTGTCAAGATGGTACAGTT<br>TGAGGAGAATGGTCGGAAAGAGATTGACATAAAAAA<br>ATATGCAAGAGTGGAAAAGATACCTGGAGGCATCATT<br>GAAGACTCCTGTGTCTTGCGTGGAGTCATGATTAACAA<br>GGATGTGACCCATCCACGTATGCGGCGCTATATCAAG<br>AACCCTCGCATTGTGCTGCTGGATTCTTCTCTGGAATAC<br>AAGAAAGGAGAAAGCCAGACTGACATTGAGATTACAC<br>GAGAGGAGGACTTCACCCGAATTCTCCAGATGGAGGA<br>AGAGTACATCCAGCAGCTCTGTGAGGACATTATCCAAC<br>TGAAGCCCGATGTGGTCATCACTGAAAAGGGCATCTC<br>AGATTTAGCTCAGCACTACCTTATGCGGGCCAATATCA<br>CAGCCATCCGCAGAGTCCGGAAGACAGACAATAATCG<br>CATTGCTAGAGCCTGTGGGGCCCGGATAGTCAGCCGA |

FIG. 27 Cont.

| sample | Gene Break-point 5p | Gene Break-point 3p | Frame Type | SEQ ID NO: | Fused Sequence |
|---|---|---|---|---|---|
| | | | | | CCAGAGGAACTGAGAGAAGATGATGTTGGAACAGGA GCAGGCCTGTTGGAAATCAAGAAAATTGGAGATGAAT ACTTTACTTTCATCACTGACTGCAAAGACCCCAAGGCC TGCACCATTCTCCTCCGGGGGGCTAGCAAAGAGATTCT CTCGGAAGTAGAACGCAACCTCCAGGATGCCATGCAA GTGTGTCGCAATGTTCTCCTGGACCCTCAGCTGGTGCC AGGGGGTGGGGCCTCCGAGATGGCTGTGGCCCATGCC TTGACAGAAAAATCCAAGGCCATGACTGGTGTGGAAC AATGGCCATACAGGGCTGTTGCCCAGGCCCTAGAGGT CATTCCTCGTACCCTGATCCAGAACTGTGGGGCCAGCA CCATCCGTCTACTTACCTCCCTTCGGGCCAAGCACACCC AGGAGAACTGTGAGACCTGGGGTGTAAATGGTGAGA CGGGTACTTTGGTGGACATGAAGGAACTGGGCATATG GGAGCCATTGGCTGTGAAGCTGCAGACTTATAAGACA GCAGTGGAGACGGCAGTTCTGCTACTGCGAATTGATG ACATCGTTTCAGGCCACAAAAAGAAAGGCGATGACCA GAGCCGGCAAGGCGGGGCTCCTGATGCTGGCCAGGA G |
| G17206. TCGA-06-0125-02A-11R-2005-01.2 | 27094490 | 24624366 | InFrame | 8320 | ATGGCCGCGCAGGTCGCCCCCGCCGCCGCCAGCAGCC TGGGCAACCCGCCGCCGCCGCCGCCCTCGGAGCTGAA GAAAGCCGAgcagcagcagcggggaggaggcggggggcgaggcg gcggcggcggcagcggcCGAGCGCGGGGAAATGAAGGCA GCCGCCGGGCAGGAAAGCGAGGGCCCCGCCGTGGGG CCGCCGCAGCCGCTGGGAAAGGAGCTGCAGGACGGG GCCGAGAGCAATGGGggtggcggcggcggcggagccggcagc ggcggcggGCCCGGCGCGGAGCCGGACCTGAAGAACTC GAACGGGAACGCGGGCCCTAGGCCCGCCCTGAACAAT AACCTCACGGAGCCGCCcggcggcggcggcggtggcggcagcagc gatggggtggggcgCCTCCTCACTCAGCCGCGGCCGCCTT GCCGCCCCAGCCTACGGCTTCGGGCAACCCTACGGCC GGAGCCCGTCTGCCGTCGCCGCCGCCGCGGCCGCCGT CTTCCACCAACAACATGGCGGACAACAAAGCCCTGGC CTGGCAGCGCTGCAGAGCGGCGGCGGCGGGGGCCTG GAGCCCTACGCGGGGCCCCAGCAGAACTCTCACGACC ACGGCTTCCCCAACCACCAGTACAACTCCTACTACCCC AACCGCAGCGCCTACCCCCCGCCCGCCCCGGCCTACGC GCTGAGCTCCCCGAGAGGTGGCACTCCGGGCTCCGGC GCGGCGGCGGCTGCCGGCTCCAAGCCGCCTCCCTCCTC CAGCGCCTCCGCCTCCTCGTCGTCTTCGTCCTTCGCTCA GCAGCGCTTCGGGGCCATGGGGGGAGGCGGCCCCCTC CGCGGCCGGCGGGGGAACTCCCCAGCCCACCGCCACC CCCACCCTCAACCAACTGCTCACGTCGCCCAGCTCGGC CCGGGGGCTACCAGGGCTACCCCGGGGGCGACTACAGT GGCGGGCCCCAGGACGGGGGCGCCGGCAAGGGCCCG GCGGACATGGCCTCGCAGTGTTGGGGggctgcggcggcgg cagctgcggcggcggcCGCCTCGGGAGGGGCCCAACAAAG GAGCCACCACGCGCCCATGAGCCCCGGGAGCAGCGGC GGCGGGGGGCAGCCGCTCGCCCGGACCCCTCAGCCAT CCAGTCCAATGGATCAGATGGGCAAGATGAGACCTCA GCCATATGGCGGGACTAACCCATACTCGCAGCAACAG GGACCTCCGTCAGGACCGCAGCAAGGACATGGGTACC CAGGGCAGCCATACGGGTCCCAGACCCCGCAGCGGTA CCCGATGACCATGCAGGGCCGGGCGCAGAGTGCCATG GGCGGCCTCTCTTATACACAGCAGATTCCTCCTTATGG ACAACAAGGCCCCAGCGGGTATGGTCAACAGGGCCAG |

| sample | Gene Break-point 5p | Gene Break-point 3p | Frame Type | SEQ ID NO: | Fused Sequence |
|---|---|---|---|---|---|
| | | | | | ACTCCATATTACAACCAGCAAAGTCCTCACCCTCAGCA
GCAGCAGCCACCCTACTCCCAGCAACCACCGTCCCAGA
CCCCTCATGCCCAACCTTCGTATCAGCAGCAGCCACAG
TCTCAACCACCACAGCTCCAGTCCTCTCAGCCTCCATAC
TCCCAGCAGCCATCCCAGCCTCCACATCAGCAGTCCCC
GGCTCCATACCCCTCCCAGCAGTCGACGACACAGCAGC
ACCCCCAGAGCCAGCCCCCCTACTCACAGCCACAGGCT
CAGTCTCCTTACCAGCAGCAGCAACCTCAGCAGCCAGC
ACCCTCGACGCTCTCCCAGCAGGCTGCGTATCCTCAGC
CCCAGTCTCAGCAGTCCCAGCAAACTGCCTATTCCCAG
CAGCGCTTCCCTCCACCGCAGGAGCTATCTCAAGATTC
ATTTGGGTCTCAGGCATCCTCAGCCCCCTCAATGACCT
CCAGTAAGGGAGGGCAAGAAGATATGAACCTGAGCCT
TCAGTCAAGACCCTCCAGCTTGCCTGATCTATCTGGTTC
AATAGATGACCTCCCCATGGGGACAGAAGGAGCTCTG
AGTCCTGGAGTGAGCACATCAGGGATTTCCAGCAGCC
AAGGAGAGCAGAGTAATCCAGCTCAGTCTCCTTTCTCT
CCTCATACCTCCCCTCACCTGCCTGGCATCCGAGGCCCT
TCCCCGTCCCCTGTTGGCTCTCCCGCCAGTGTTGCTCAG
TCTCGCTCAGGACCACTCTCGCCTGCTGCAGTGCCAGG
CAACCAGATGCCACCTCGGCCACCCAGTGGCCAGTCG
GACAGCATCATGCATCCTTCCATGAACCAATCAAGCAT
TGCCCAAGATCGAGGTTATATGCAGAGGAACCCCCAG
ATGCCCCAGTACAGTTCCCCCCAGCCCGGCTCAGCCTT
ATCTCCGCGTCAGCCTTCCGGAGGACAGATACACACA
GGCATGGGCTCCTACCAGCAGAACTCCATGGGGAGCT
ATGGTCCCCAGGGGGGTCAGTATGGCCCACAAGGTGG
CTACCCCAGGCAGCCAAACTATAATGCCTTGCCCAATG
CCAACTACCCCAGTGCAGGCATGGCTGGAGGCATAAA
CCCCATGGGTGCCGGAGGTCAAATGCATGGACAGCCT
GGCATCCCACCTTATGGCACACTCCCTCCAGGGAGGAT
GAGTCACGCCTCCATGGGCAACCGGCCTTATGGCCCTA
ACATGGCCAATATGCCACCTCAGGTTGGGTCAGGGAT
GTGTCCCCACCAGGGGGCATGAACCGGAAAACCCAA
GAAACTGCTGTCGCCATGCATGTTGCTGCCAACTCTAT
CCAAAACAGGCCGCCAGGCTACCCCAATATGAATCAA
GGGGGCATGATGGGAACTGGACCTCCTTATGGACAAG
GGATTAATAGTATGGCTGGCATGATCAACCCTCAGGG
ACCCCATATTCCATGGGTGGAACCATGGCCAACAATT
CTGCAGGGATGGCAGCCAGCCCAGAGATGATGGGCCT
TGGGGATGTAAAGTTAACTCCAGCCACCAAAATGAAC
AACAAGGCAGATGGGACACCCAAGACAGAATCCAAAT
CCAAGAAATCCAGTTCTTCTACTACAACCAATGAGAAG
ATCACCAAGTTGTATGAGCTGGGTGGTGAGCCTGAGA
GGAAGATGTGGGTGGACCGTTATCTGGCCTTCACTGA
GGAGAAGGCCATGGGCATGACAAATCTGCCTGCTGTG
GGTAGGAAACCTCTGGACCTCTATCGCCTCTATGTGTC
TGTGAAGGAGATTGGTGGATTGACTCAG|ATGCAGGC
CCTGACTTCCTGTGAGTGCACCATCTGTCCTGACTGCTT
CCGCCAGCACTTCACCATCGCCTTGAAGGAGAAGCAC
ATCACAGACATGGTGTGCCCTGCCTGTGGCCGCCCCGA
CCTCACCGATGACACACAGTTGCTCAGCTACTTCTCTAC
CCTTGACATCCAGCTTCGCGAGAGCCTAGAGCCAGAT
GCCTATGCGTTGTTCCATAAGAAGCTGACCGAGGGTG
TGCTGATGCGGGACCCCAAGTTCTTGTGGTGTGCCCAG |

FIG. 27 Cont.

| sample | Gene Break-point 5p | Gene Break-point 3p | Frame Type | SEQ ID NO: | Fused Sequence |
|---|---|---|---|---|---|
| | | | | | TGCTCCTTTGGCTTCATATATGAGCGTGAGCAGCTGGA GGCAACTTGTCCCCAGTGTCACCAGACCTTCTGTGTGC GCTGCAAGCGCCAGTGGGAGGAGCAGCACCGAGGTC GGAGCTGTGAGGACTTCCAGAACTGGAAACGCATGAA CGACCCAGAATACCAGGCCCAGGGCCTAGCAATGTAT CTTCAGGAAAACGGCATTGACTGCCCCAAATGCAAGTT CTCGTACGCCCTGGCCCGAGGAGGCTGCATGCACTTTC ACTGTACCCAGTGCCGCCACCAGTTCTGCAGCGGCTGC TACAATGCCTTTTACGCCAAGAATAAATGTCCAGAGCC TAACTGCAGGGTGAAAAAGTCCCTGCACGGCCACCAC CCTCGAGACTGCCTCTTCTACCTGCGGGACTGGACTGC TCTCCGGCTTCAGAAGCTGCTACAGGACAATAACGTCA TGTTTAATACAGAGCCTCCAGCTGGGGCCCGGGCAGT CCCTGGAGGCGGCTGCCGAGTGATAGAGCAGAAGGA GGTTCCCAATGGGCTCAGGGACGAAGCTTGTGGCAAG GAAACTCCAGCTGGCTATGCCGGCCTGTGCCAGGCAC ACTACAAAGAGTATCTTGTGAGCCTCATCAATGCCCAC TCGCTGGACCCAGCCACCTTGTATGAGGTGGAAGAGC TGGAGACGGCCACTGAGCGCTACCTGCACGTACGCCC CCAGCCTTTGGCTGGAGAGGATCCCCCTGCTTACCAGG CCCGCTTGTTACAGAAGCTGACAGAAGAGGTACCCTT GGGACAGAGTATCCCCCGCAGGCGGAAG |
| G17792. TCGA-28-5204-01A-01R-1850-01.4 | 36204176 | 33911962 | InFrame | 8321 | ATGGCTGAGCTGGATCCGTTCGGCGCCCCTGCCGGCG CCCCTGGCGGTCCCGCGCTGGGGAACGGAGTGGCCG GCGCCGGCGAAGAAGACCCGGCTGCGGCCTTCTTGGC GCAGCAAGAGAGCGAGATTGCGGGCATCGAGAACGA CGAGGCCTTCGCCATCCTGGAcggcggcgccccccgggcccca gccgcacggcggagccgccgggggTCCGGATGCTGTTGATGG AGTAATGAATGGTGAATACTACCAGGAAAGTAATGGT CCAACAGACAGTTATGCAGCTATTTCACAAGTGGATCG ATTGCAGTCAGAGCCTGAAAGTATCCGTAAATGGAGA GAAGAACAAATGGAACGCTTGGAAGCCCTTGATGCCA ATTCTCGGAAGCAAGAAGCAGAGTGGAAAGAAAAGG CAATAAAGGAGCTAGAAGAATGGTATGCAAGACAGG ACGAGCAGCTACAGAAAACAAAAGCAAACAACAG\|GA CTATCCTATTAAGTGTAATCTCACTGCTTAATGAGCCCA ACACCTTCTCCCCAGCCAATGTCGATGCTTCAGTTATGT TCAGGAAATGGAGAGACAGTAAGGAAAAGACAAAG AATATGCTGAAATTATTAGGAAACAAGTTTCAGCCACT AAGGCCGAAGCAGAAAAGGATGGAGTGAAGGTCCCC ACAACCCTGGCGGAATACTGCATCAAAACTAAAGTGC CTTCCAATGACAACAGCTCAGATTTGCTTTACGACGAC TTGTatgatgacgacattgatgatgaagatgaggaggaggaagatgc cgactgttatgatgatgatgatTCTGGGAATGAGGAGTCG |
| G17663. TCGA-19-2619-01A-01R-1850-01.2 | 205719085 | 205811017 | InFrame | 8322 | ATGTCGCGGCCTGTCAG\|GTTTATGGAGAGAAATCCCT TAACCAATGCAATAATCAGGACCACCACGGCACTCACC ATATTCAAAGCAGGGGTCAAGTTCAATGTCATCCCCCC AGTGGCCCAGGCCACAGTCAACTTCCGGATTCACCCTG GACAGACAGTCCAAGAGGTCCTAGAACTCACGAAGAA CATTGTGGCTGATAACAGAGTCCAGTTCCATGTGTTGA GTGCCTTTGACCCCCTCCCCGTCAGCCCTTCTGATGACA AGGCCTTGGGCTACCAGCTGCTCCGCCAGACCGTACA GTCCGTCTTCCCGGAAGTCAATATTACTGCCCCAGTTA CTTCTATTGGCAACACAGACAGCCGATTCTTTACAAAC CTCACCACTGGCATCTACAGGTTCTACCCCATCTACATA |

FIG. 27 Cont.

| sample | Gene Break- point 5p | Gene Break- point 3p | Frame Type | SEQ ID NO: | Fused Sequence |
|---|---|---|---|---|---|
| | | | | | CAGCCTGAAGACTTCAAACGCATCCATGGAGTCAACG AGAAAATCTCAGTCCAAGCCTATGAGACCCAAGTGAA ATTCATCTTTGAGTTGATTCAGAATGCTGACACAGACC AGGAGCCAGTTTCTCACCTGCACAAACTG |
| NYU_E | 69333677 | 69349911 | InFrame | 8323 | ATGAGGGTAGCTGCGGCGACTGCGGCGGCTGGAGCG GGGCCGGCCATGGCGGTGTGGACGCGGGCCACCAAA GCGGGGCTGGTGGAGCTGCTCCTGAGGGAGCGCTGG GTCCGAGTGGTGGCCGAGCTGAGCGGGGAGAGCCTG AGCCTGACGGGCGACGCCGCCGCGGCCGAGCTGGAG CCCGCTCTGGGACCCGCGGCCGCCGCCTTCAACGGCCT CCCAAACGGCGGCGGCGCGGGCGACTCGCTGCCCGG GAGCCCAAgccgcggcctggggccccgagcccgccggcgccgcct cggggccccgcgggtgaggcgggcgcgtcgccgcccgtgcgccgggT GCGGGTGGTGAAGCAAGAGGCGGGCGGCCTGGGCAT CAGCATCAAGGGCGGCCGCGAGAACCGGATGCCGATC CTCATCTCCAAGATCTTCCCCGGGCTGGCTGCCGACCA GAGCCGGGCGCTGCGGCTGGGCGACGCCATCCTGTCG GTGAACGGCACCGACCTGCGCCAGGCCACCCACGACC AGGCCGTGCAGGCGCTGAAGCGCGCGGGCAAGGAGG TGCTGCTGGAGGTCAAGTTCATCCGAGAAGTAACACC ATATATCAAGAAGCCATCATTAGTATCAGATCTGCCGT GGGAAGGTGCAGCCCCCCAGTCACCAAGCTTTAGTGG CAGTGAGGACTCTGGTTCGCCAAAACACCAGAACAGC ACCAAGGACAGGAAGATCATCCCTCTCAAAATGTGCTT TGCTGCTAGAAACCTAAGCATGCCGGATCTGGAAAAC AGATTGATAGAGCTACATTCTCCTGATAGCAGGAACAC GTTGATCCTACGCTGCAAAGATACAGCCACAGCACACT CCTGGTTCGTAGCTATCCACACCAACATAATGGCTCTC CTCCCACAGGTGTTGGCTGAACTCAACGCCATGCTTGG GGCAACCAGTACAGCAGGAGGCAGTAAAGAGGTGAA GCATATTGCCTGGCTGGCAGAACAGGCAAAACTAGAT GGTGGAAGACAGCAATGGAGACCTGTCCTCATGGCTG TGACTGAGAAGGATTTGCTGCTCTATGACTGTATGCCG TGGACAAGAGATGCCTGGGCGTCACCATGCCACAGCT ACCCACTTGTTGCCACCAGGTTGGTTCATTCTGGCTCC GGATGTCGATCCCCCTCCCTTGGATCTGACCTTACATTT GCTACCAGGACAGGCTCTCGACAGGGCATTGAGATGC ATCTCTTCAGGGTGGAGACACATCGGGATCTGTCATCC TGGACCAGGATACTTGTTCAGGGTTGCCATGCTGCTGC TGAGCTGATCAAGGAAGTCTCTCTAGGCTGCATGTTAA ATGGCCAAGAGGTGAGGCTTACTATTCACTATGAAAAT GGGTTCACCATCTCAAGGGAAAATGGAGGCTCCAGCA GCATATTGTACCGCTACCCCTTTGAAAGGCTGAAGATG TCTGCTGATGATGGCATCCGAAATCTATACTTGGATTTT GGTGGTCCCGAGGGAGAACTG\|AAAGCCATTGATCTG GTGACGAAAGCCACAGAGGAGGACAAAGCCAAGAAC TACGAGGAGGCGCTGCGGCTGTACCAGCATGCGGTGG AGTACTTCCTCCACGCTATCAAGTATGAGGCCCACAGC GACAAGGCCAAGGAGAGCATTCGAGCCAAGTGCGTG CAGTACCTAGACCGGGCCGAGAAGCTGAAGGATTATT TACGAAGCAAAGAGAAACACGGCAAGAAGCCAGTCA AAGAGAACCAGAGTGAGGGCAAGGGCAGTGACAGTG ACAGTGAAGGGGATAATCCGGAGAAAAAGAAACTGC AAGAACAGCTGATGGGTGCCGTCGTGATGGAGAAGCC CAACATACGGTGGAACGACGTGGCCGGGCTGGAGGG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GGCCAAGGAGGCCCTCAAAGAAGCTGTCATTTTGCCA ATCAAATTCCCACACTTGTTCACAGGCAAGCGCACCCC CTGGCGGGGGATTCTGCTGTTCGGACCCCCTGGCACA GGGAAATCCTACCTGGCCAAAGCCGTGGCAACAGAGG CCAACAACTCCACCTTCTTCTCTGTGTCCTCCTCAGATC TGATGTCCAAGTGGCTGGGGGAGAGTGAAAAGCTGG TCAAGAACCTGTTTGAGCTGGCCAGGCAGCACAAGCC CTCCATCATCTTCATCGATGAGGTGGATTCCCTCTGCG GGTCCCGAAATGAAAATGAGAGTGAGGCCGCCCGGA GGATCAAAACGGAGTTCTTGGTCCAGATGCAGGGGGT GGGGAATAACAATGATGGGACTCTGGTTCTTGGAGCC ACAAACATCCCATGGGTGTTGGATTCGGCCATCAGGA GGAGGTTTGAAAAACGAATTTATATCCCCTTGCCGGAG GAAGCTGCCCGCGCCCAGATGTTCCGGTTGCATCTCGG GAGCACTCCCCACAACCTCACGGATGCAAACATCCACG AGCTGGCCCGGAAGACGGAAGGCTACTCGGGCGCGG ACATCAGCATCATCGTGCGGGACTCTCTCATGCAGCCC GTGAGGAAGGTGCAGTCGGCCACACACTTCAAAAAGG TCTGTGGCCCCTCTCGCACCAACCCCAGCATGATGATT GATGACCTCCTGACTCCATGCTCACCAGGGGACCCAG GAGCCATGGAGATGACTTGGATGGATGTCCCTGGGGA CAAACTCTTAGAGCCTGTGGTTTGCATGTCGGACATGC TGCGGTCTCTGGCCACCACCCGGCCCACGGTGAATGC AGACGACCTCCTGAAAGTGAAGAAATTCTCAGAGGAC TTTGGGCAAGAGAGT |
| NYU_G | 42759130 | 42744294 | InFrame | 8324 | ATGAAGACCCCGGCGGACACAG\|GTGACAGCGGGAA GGTGACCACAGTCGTAGCCACTCTAGGCCAAGGCCCA GAGCGCTCCCAAGAAGTGGCTTACACGGACATCAAAG TGATTGGCAATGGCTCATTTGGGGTCGTGTACCAGGC ACGGCTGGCAGAGACCAGGGAACTAGTCGCCATCAAG AAGGTTCTCCAGGACAAGAGGTTCAAGAACCGAGAGC TGCAGATCATGCGTAAGCTGGACCACTGCAATATTGTG AGGCTGAGATACTTTTTCTACTCCAGTGGCGAGAAGAA AGACGAGCTTTACCTAAATCTGGTGCTGGAATATGTGC CCGAGACAGTGTACCGGGTGGCCCGCCACTTCACCAA GGCCAAGTTGACCATCCCTATCCTCTATGTCAAGGTGT ACATGTACCAGCTCTTCCGCAGCTTGGCCTACATCCACT CCCAGGGCGTGTGTCACCGCGACATCAAGCCCCAGAA CCTGCTGGTGGACCCTGACACTGCTGTCCTCAAGCTCT GCGATTTTGGCAGTGCAAAGCAGTTGGTCCGAGGGGA GCCCAATGTCTCCTACATCTGTTCTCGCTACTACCGGGC CCCAGAGCTCATCTTTGGAGCCACTGATTACACCTCAT CCATCGATGTTTGGTCAGCTGGCTGTGTACTGGCAGAG CTCCTCTTGGGCCAGCCCATCTTCCCTGGGGACAGTGG GGTGGACCAGCTGGTGGAGATCATCAAGGTGCTGGG AACACCAACCCGGGAACAAATCCGAGAGATGAACCCC AACTACACGGAGTTCAAGTTCCCTCAGATTAAAGCTCA CCCCTGGACAAAGGTGTTCAAATCTCGAACGCCGCCA GAGGCCATCGCGCTCTGCTCTAGCCTGCTGGAGTACAC CCCATCCTCAAGGCTCTCCCCACTAGAGGCCTGTGCGC ACAGCTTCTTTGATGAACTGCGATGTCTGGGAACCCAG CTGCCTAACAACCGCCCACTTCCCCCTCTCTTCAACTTC AGTGCTGGTGAACTCTCCATCCAACCGTCTCTCAACGC CATTCTTATCCCTCCTCACTTGAGGTCCCCAGCGGGCAC TACCACCCTCACCCCGTCCTCACAAGCTTTAACTGAGAC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TCCGACCAGCTCAGACTGGCAGTCGACCGATGCCACA CCTACCCTCACTAACTCCTCC |
| NYU_B | 6457893 | 6443410 | InFrame | 8325 | ATGGGCATGGCCAGGGGCAGCCTCACTCGGGTTCCAG GGGTGATGGGAGAGGGCACTCAGGGCCCAGAGCTCA GCCTTGACCCTGACCCTTGCTCTCCCCAATCCACTCCGG GGCTCATGAAGGGGAACAAGCTGGAGGAGCAGGACC CTAGACCTCTGCAGCCCATACCAGGTCTCATGGAGGG GAACAAGCTGGAGGAGCAGGACTCTAGCCCTCCACAG TCCACTCCAGGGCTCATGAAGGGGAACAAGCGTGAGG AGCAGGGGCTGGGCCCCGAACCTGCGGCGCCCCAGCA GCCCACGGCGGAGGAGGAGGCCCTGATCGAGTTCCAC CGCTCCTACCGAGAGCTCTTCGAGTTCTTCTGCAACAA CACCACCATCCACGGCGCCATCCGCCTGGTGTGCTCCC AGCACAACCGCATGAAGACGGCCTTCTGGGCAGTGCT GTGGCTCTGCACCTTTGGCATGATGTACTGGCAATTCG GCCTGCTTTTCGGAGAGTACTTCAGCTACCCCGTCAGC CTCAACATCAACCTCAACTCGGACAAGCTCGTCTTCCCC GCAGTGACCATCTGCACCCTCAATCCCTACAGGTACCC GGAAATTAAAGAGGAGCTGGAGGAGCTGGACCGCAT CACAGAGCAGACGCTCTTTGACCTGTACAAATACAGCT CCTTCACCACTCTCGTGGCCGGCTCCCGCAGCCGTCGC GACCTGCGGGGACTCTGCCGCACCCCTTGCAGCGCC TGAGGGTCCCGCCCCCGCCTCACGGGGCCCGTCGAGC CCGTAGCGTGGCCTCCAGCTTGCGGGACAACAACCCC CAGGTGGACTGGAAGGACTGGAAGATCGGCTTCCAGC TGTGCAACCAGAACAAATCGGACTGCTTCTACCAGACA TACTCATCAGGGGTGGATGCGGTGAGGGAGTGGTACC GCTTCCACTACATCAACATCCTGTCGAGGCTGCCAGAG ACTCTGCCATCCCTGGAGGAGGACACGCTGGGCAACT TCATCTTCGCCTGCCGCTTCAACCAGGTCTCCTGCAACC AGGCGAATTACTCTCACTTCCACCACCCGATGTATGGA AACTGCTATACTTTCAATGACAAGAACAACTCCAACCT CTGGATGTCTTCCATGCCTGGAATCAACAACGGTCTGT CCCTGATGCTGCGCGCAGAGCAGAATGACTTCATTCCC CTGCTGTCCACAGTGACTGGGGCCCGGGTAATGGTGC ACGGGCAGGATGAACCTGCCTTTATGGATGATGGTGG CTTTAACTTGCGGCCTGGCGTGGAGACCTCCATCAGCA TGAGGAAGGAAACCCTGGACAGACTTGGGGGCGATT ATGGCGACTGCACCAAGAATGGCAGTGATGTTCCTGTT GAGAACCTTTACCCTTCAAAGTACACACAGCAGGTGTG TATTCACTCCTGCTTCCAGGAGAGCATGATCAAGGAGT GTGGCTGTGCCTACATCTTCTATCCGCGGCCCCAGAAC GTGGAGTACTGTGACTACAGAAAGCACAGTTCCTGGG GGTACTGCTACTATAAGCTCCAGGTTGACTTCTCCTCA GACCACCTGGGCTGTTTCACCAAGTGCCGGAAGCCAT GCAGCGTGACCAGCTACCAGCTCTCTGCTGGTTACTCA CGATGGCCCTCGGTGACATCCCAGGAATGGGTCTTCCA GATGCTATCGCGACAGAACAATTACACCGTCAACAACA AGAGAAATGGAGTGGCCAAAGTCAACATCTTCTTCAA GGAGCTGAACTACAAAACCAATTCTGAGTCTCCCTCTG TCACG\|GTGCTCCTGGAGCTGTTGGTGGGAATATACCC CTCAGGGGTTATTGGACTGGTCCCTCACCTAGGGGAC AGGGAGAAGAGAGATAGTGTGTGTCCCCAAGGAAAA TATATCCACCCTCAAAATAATTCGATTTGCTGTACCAAG TGCCACAAAGGAACCTACTTGTACAATGACTGTCCAGG |

FIG. 27 Cont.

| sample | Gene Break-point 5p | Gene Break-point 3p | Frame Type | SEQ ID NO: | Fused Sequence |
|---|---|---|---|---|---|
| | | | | | CCCGGGGCAGGATACGGACTGCAGGGAGTGTGAGAG CGGCTCCTTCACCGCTTCAGAAAACCACCTCAGACACT GCCTCAGCTGCTCCAAATGCCGAAAGGAAATGGGTCA GGTGGAGATCTCTTCTTGCACAGTGGACCGGGACACC GTGTGTGGCTGCAGGAAGAACCAGTACCGGCATTATT GGAGTGAAAACCTTTTCCAGTGCTTCAATTGCAGCCTC TGCCTCAATGGGACCGTGCACCTCTCCTGCCAGGAGAA ACAGAACACCGTGTGCACCTGCCATGCAGGTTTCTTTC TAAGAGAAAACGAGTGTGTCTCCTGTAGTAACTGTAA GAAAAGCCTGGAGTGCACGAAGTTGTGCCTACCCCAG ATTGAGAATGTTAAGGGCACTGAGGACTCAGGCACCA CAGTGCTGTTGCCCCTGGTCATTTTCTTTGGTCTTTGCC TTTTATCCCTCCTCTTCATTGGTTTAATGTATCGCTACCA ACGGTGGAAGTCCAAGCTCTACTCCATTGTTTGTGGGA AATCGACACCTGAAAAAGAGGGGGAGCTTGAAGGAA CTACTACTAAGCccctggccccaaacccaagcttcagtcccactcc aggcttcaccccaccctgggcttcagtcccgtgcccagttccaccttca cctccagctccaCCTATACCCCCGGTGACTGTCCCAACTTT GCGGCTCCCCGCAGAGAGGTGGCACCACCCTATCAGG GGGCTGACCCCATCCTTGCGACAGCCCTCGCCTCCGAC CCCATCCCCAACCCCCTTCAGAAGTGGGAGGACAGCG CCCACAAGCCACAGAGCCTAGACACTGATGACCCCGC GACGCTGTACGCCGTGGTGGAGAACGTGCCCCCGTTG CGCTGGAAGGAATTCGTGCGGCGCCTAGGGCTGAGCG ACCACGAGATCGATCGGCTGGAGCTGCAGAACGGGC GCTGCCTGCGCGAGGCGCAATACAGCATGCTGGCGAC CTGGAGGCGGCGCACGCCGCGGCGCGAGGCCACGCT GGAGCTGCTGGGACGCGTGCTCCGCGACATGGACCTG CTGGGCTGCCTGGAGGACATCGAGGAGGCGCTTTgcgg ccccgccgcccccgcccgcccAGTCTTCTCAGA |
| G17675. TCGA-19- 2624- 01A-01R- 1850- 01.2 | 69230529 | 63195940 | InFrame | 8326 | ATGGTGAGGAGCAGGCAAATGTGCAATACCAACATGT CTGTACCTACTGATGGTGCTGTAACCACCTCACAGATT CCAGCTTCGGAACAAGAGACCCTGGTTAGACCAAAGC CATTGCTTTTGAAGTTATTAAAGTCTGTTGGTGCACAA AAAGACACTTATACTATGAAAGAGGTTCTTTTTTATCTT GGCCAGTATATTATGACTAAACGATTATATGATGAGAA GCAACAACATATTGTATATTGTTCAAATGATCTTCTAG GAGATTTGTTTGGCGTGCCAAGCTTCTCTGTGAAAGAG CACAGGAAAATATATACCATGATCTACAGGAACTTGGT AGTAGTCAATCAGCAGGAATCATCGGACTCAGGTACA TCTGTGAGTGAGAACAGGTGTCACCTTGAAGGTGGGA GTGATCAAAAGGACCTTGTACAAGAGCTTCAGGAAGA GAAACCTTCATCTTCACATTTGGTTTCTAGACCATCTAC CTCATCTAGAAGGAGAGCAATTAGTGAGACAGAAGAA AATTCAGATGAATTATCTGGTGAACGACAAAGAAAAC GCCACAAATCTGATAGTATTTCCCTTTCCTTTGATGAAA GCCTGGCTCTGTGTGTAATAAGGGAGATATGTTGTGA AAGAAGCAGTAGCAGTGAATCTACAGGGACGCCATCG AATCCGGATCTTGATGCTGGTGTAAGTGAACATTCAGG TGATTGGTTGGATCAGGATTCAGTTTCAGATCAGTTTA GTGTAGAATTTGAAGTTGAATCTCTCGACTCAGAAGAT TATAGCCTTAGTGAAGAAGGACAAGAACTCTCAGATG AAGATGATGAGGTATATCAAGTTACTGTGTATCAGGC AGGGGAGAGTGATACAGATTCATTTGAAGAAGATCCT GAAATTTCCTTAGCT\|GAATCCGAGGGTGTTTCCTGCC |

FIG. 27 Cont.

| sample | Gene Break-point 5p | Gene Break-point 3p | Frame Type | SEQ ID NO: | Fused Sequence |
|---|---|---|---|---|---|
|  |  |  |  |  | ACTATTGGTCGCTGTTTGACGGGCACGCGGGGTCCGG GGCCGCGGTGGTGGCGTCACGCCTGCTGCAGCACCAC ATCACGGAGCAGCTGCAGGACATCGTGGACATCCTGA AGAACTCCGCCGTCCTGCCCCCTACCTGCCTGGGGGAG GAGCCTGAGAACACGCCCGCCAACAGCCGGACTCTGA CCCGGGCAGCCTCCCTGCGCGGAGGGGTGGGGGCCC CGGGCTCCCCCAGCACGCCCCCCACACGCTTCTTTACC GAGAAGAAGATTCCCCATGAGTGCCTGGTCATCGGAG CGCTTGAAAGTGCATTCAAGGAAATGGACCTACAGAT AGAACGAGAGAGGAGTTCATATAATATATCTGGTGGC TGCACGGCCCTCATTGTGATTTGCCTTTTGGGGAAGCT GTATGTTGCAAATGCTGGGGATAGCAGGGCCATAATC ATCAGAAATGGAGAAATTATCCCCATGTCTTCAGAATT TACCCCCGAGACGGAGCGCCAGCGACTTCAGTACCTG GCATTCATGCAGCCTCACTTGCTGGGAAATGAGTTCAC ACATTTGGAGTTTCCAAGGAGAGTACAGAGAAAGGAG CTTGGAAAGAAGATGCTCTACAGGGACTTTAATATGAC AGGCTGGGCATACAAAACCATTGAGGATGAGGACTTG AAGTTCCCCCTTATATATGGAGAAGGCAAGAAGGCCC GGGTAATGGCAACTATTGGAGTGACCAGGGGACTTGG GGACCATGACCTGAAGGTGCATGACTCCAACATCTACA TTAAACCATTCCTGTCTTCAGCTCCAGAGGTAAGAATC TACGATCTTTCAAAATATGATCATGGATCAGATGATGT GCTGATCTTGGCCACTGATGGACTCTGGGACGTTTTAT CAAATGAAGAAGTAGCAGAAGCAATCACTCAGTTTCTT CCTAACTGTGATCCAGATGATCCTCACAGGTACACACT GGCAGCTCAGGACCTGGTGATGCGTGCCCGGGGTGTG CTGAAGGACAGAGGATGGCGGATATCTAATGACCGAC TGGGCTCAGGAGACGACATTTCTGTATATGTCATTCCT TTAATACATGGAAACAAGCTGTCA |
| G17484. TCGA-14-0787-01A-01R-1849-01.2 | 155385535 | 156384545 | InFrame | 8327 | ATGGACCCTAGAAATACTGCTATGTTAGGATTGGGTTC TGATTCCGAAGGTTTTTCAAGAAAGAGTCCTTCTGCCA TCAGTACTGGCACATTGGTCAGTAAGAGAGAAGTAGA GCTAGAAAAAAACACAAAGGAGGAAGAGGACCTTCG CAAACGGAATCGAGAAAGAAACATCGAAGCTGGGAA AGATGATGGTTTGACTGATGCACAGCAACAGTTTTCAG TGAAAGAAACAAACTTTTCAGAGGGAAATTTAAAATT GAAAATTGGCCTCCAGGCTAAGAGAACTAAAAAACCT CCAAAGAACTTGGAGAACTATGTATGTCGACCTGCCAT AAAAACAACTATTAAGCACCCAAGGAAAGCACTTAAA AGTGGAAAGATGACGGATGAAAAGAATGAACACTGTC CTTCAAAACGAGACCCTTCAAAGTTGTACAAGAAAGCA GATGATGTTGCAGCCATTGAATGCCAGTCTGAAGAAG TCATCCGTCTTCATTCACAGGGAGAAAACAATCCTTTG TCTAAGAAGCTGTCTCCAGTACACTCAGAAATGGCAGA TTATATTAATGCAACGCCATCTACTCTTCTTGGTAGCCG GGATCCTGATTTAAAGGACAGAGCATTACTTAATGGA GGAACTAGTGTAACAGAAAAGTTGGCACAGCTGATTG CTACCTGTCCTCCTTCCAAGTCTTCCAAGACAAAACCGA AGAAGTTAGGAACTGGCACTACAGCAGGATTGGTTAG CAAGGATTTGATCAGGAAAGCAGGTGTTGGCTCTGTA GCTGGAATAATACATAAGGACTTAATAAAAAAGCCAA CCATCAGCACAGCCAGTTGGATTGGTAACTAAAGATCCT GGGAAAAAGCCAGTGTTTAATGCAGCAGTAGGATTGG TCAATAAGGACTCTGTGAAAAAACTGGGAACTGGCAC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TACAGCGGTATTCATTAATAAAAACTTAGGCAAAAAGC<br>CAGGAACTATCACTACAGTAGGACTGCTAAGCAAAGA<br>TTCAGGAAAGAAGCTAGGAATTGGTATTGTTCCAGGTT<br>TAGTGCATAAAGAGTCTGGCAAGAAGTTAGGACTTGG<br>CACTGTGGTTGGACTGGTTAATAAAGATTTGGGAAAG<br>AAATTGGGTTCTACTGTTGGCCTAGTGGCCAAGGACTG<br>TGCAAAGAAGATTGTAGCAAGTTCAGCAATGGGATTG<br>GTTAATAAGGACATTGGAAAGAAACTAATGAGTTGTC<br>CTTTGGCAGGTCTGATCAGTAAAGATGCCATAAACCTT<br>AAAGCCGAAGCACTGCTCCCCACTCAGGAACCGCTTAA<br>GGCTTCTTGTAGTACAAACATCAATAATCAGGAAAGTC<br>AGGAACTTTCTGAATCCCTGAAAGATAGTGCCACCAGC<br>AAAACTTTTGAAAAGAATGTTGTACGGCAGAATAAAG<br>AAAGCATATTGGAAAAGTTCTCAGTACGAAAAGAAAT<br>CATTAATTTGGAGAAAGAAATGTTTAATGAAGGAACA<br>TGCATTCAGCAAGACAGTTTCTCATCCAGTGAAAAGGG<br>ATCTTATGAAACCTCAAAGCATGAAAAGCAGCCTCCTG<br>TATATTGCACTTCTCCGGACTTTAAAATGGGAGGTGCT<br>TCTGATGTATCTACCGCTAAATCCCCATTCAGTGCAGTA<br>GGAGAAAGCAATCTCCCTTCCCCATCACCTACTGTATCT<br>GTTAATCCTTTAACCAGAAGTCCCCCTGAAACTTCTTCA<br>CAGTTGGCTCCTAATCCATTACTTTTAAGTTCTACTACA<br>GAACTAATCGAAGAAATTTCTGAATCTGTTGGAAAGA<br>ACCAGTTTACTTCTGAAAGTACCCACTTGAACGTTGGT<br>CATAGGTCAGTTGGTCATAGTATAAGTATTGAATGTAA<br>AGGGATTGATAAAGAGGTAAATGATTCAAAAACTACC<br>CATATAGATATTCCAAGAATAAGCTCTTCCCTTGGAAA<br>AAAGCCAAGTTTGACTTCTGAATCCAGCATTCATACTA<br>TTACTCCTTCAGTTGTTAACTTCACTAGTTTATTTAGTA<br>ATAAGCCTTTTTAAAAACTGGGTGCAGTATCTGCATCA<br>GACAAACACTGCCAAGTTGCTGAAAGCCTAAGTACTA<br>GTTTGCAGTCCAAACCATTAAAAAAAAGAAAAGGAAG<br>AAAACCTCGGTGGACTAAAGTGGTGGCAAGAAGCACA<br>TGCCGGTCTCCAAAAGGGCTAGAATTAGAAAGATCAG<br>AGCTTTTTAAAAACGTTTCATGTAGCTCACTATCAAATA<br>GTAATTCTGAGCCAGCCAAGTTTATGAAAAACATTGGA<br>CCCCCTTCATTTGTAGATCATGACTTCCTTAAACGCCGA<br>TTGCCAAAGTTGAGCAAATCCACAGCTCCATCTCTTGC<br>TCTCTTAGCTGATAGTGAAAAACCATCTCATAAGTCTTT<br>TGCTACTCACAAACTATCCTCCAGTATGTGTGTCTCTAG<br>TGACCTTTTGTCTGATATTTATAAGCCCAAAAGAGGAA<br>GGCCTAAATCTAAGGAGATGCCTCAACTGGAAGGGCC<br>ACCTAAAAGGACTTTAAAAATCCCTGCTTCTAAAGTGT<br>TTTCTTTACAGTCTAAGGAAGAACAAGAACCCCCAATT<br>TTACAGCCAGAAATTGAAATCCCTTCCTTCAAACAAGG<br>TCTGTCTGTGTCTCCTTTTCCAAAAAAGAGAGGCAGGC<br>CTAAGAGGCAAATGAGGTCACCAGTCAAGATGAAGCC<br>ACCTGTACTGTCAGTGGCTCCATTTGTTGCCACTGAAA<br>GTCCAAGCAAGCTAGAATCTGAAAGTGACAACCATAG<br>AAGTAGCAGTGATTTCTTTGAGAGCGAGGATCAACTTC<br>AGGATCCAGATGACCTAGATGACAGTCATAGGCCAAG<br>TGTCTGTAGTATGAGTGACCTTGAGATGGAACCAGAT<br>AAAAAAATTACCAAGAGAAACAATGGACAATTAATGA<br>AAACAATTATCCGCAAAATAAATAAAATGAAGACTTTA<br>AAGAGAAAGAAACTGTTGAATCAGATTCTTTCAAGTTC |

FIG. 27 Cont.

| sample | Gene Break-point 5p | Gene Break-point 3p | Frame Type | SEQ ID NO: | Fused Sequence |
|---|---|---|---|---|---|
| | | | | | TGTAGAATCAAGTAATAAAGGGAAAGTGCAATCCAAA<br>CTCCATAATACGGTATCAAGTCTTGCTGCCACATTTGG<br>CTCTAAATTGGGCCAACAGATAAATGTCAGCAAGAAA<br>GGAACCATTTATATAGGAAAGAGAAGAGGTCGCAAAC<br>CAAAAACTGTCTTAAATGGTATTCTTTCTGGTAGTCCTA<br>CTAGCCTTGCTGTTCTTGAGCAAACAGCTCAACAGGCA<br>GCTGGGTCAGCATTAGGACAGATTCTTCCCCCATTACT<br>GCCTTCATCTGCTAGTAGTTCTGAGATTCTTCCATCACC<br>TATTTGCTCTCAGTCTTCTGGGACTAGTGGAGGTCAGA<br>GCCCTGTAAGTAGTGATGCAGGTTTTGTTGAACCCAGT<br>TCAGTGCCATATTTGCATTTACACTCCAGACAGGGCAG<br>TATGATTCAGACTCTTGCAATGAAGAAGGCCTCAAAG<br>GGGAGGAGGCGGTTATCTCCTCCTACTTTGTTGCCAAA<br>TTCTCCTTCGCACTTGAGTGAACTCACATCTCTAAAAGA<br>AGCTACTCCTTCCCCAATCAGTGAGTCTCATAGTGATG<br>AGACCATTCCCAGTGATAGTGGAATTGGAACAGATAA<br>TAACAGCACATCAGACAGGGCAGAGAGAAATTTTGTGGG<br>CAAAAAAAGAGGAGGCATTCTTTTGAGCATGTTTCTCT<br>GATTCCCCCTGAAACCTCTACAGTGCTAAGCAGTCTTA<br>AAGAAAAACATAAACACAAATGTAAGCGCAGGAATCA<br>TGATTACCTCAGCTATGACAAGATGAAAAGGCAGAAA<br>CGAAAACGGAAAAAGAAATATCCCCAGCTTCGAAATA<br>GACAGGATCCAGACTTTATTGCAGAGCTGGAGGAACT<br>AATAAGTCGCCTAAGTGAAATTCGGATCACTCATCGAA<br>GTCATCATTTTATCCCCCGAGATCTTCTGCCAACTATCT<br>TTCGAATCAACTTTAATAGTTTCTATACACATCCTTCTTT<br>CCCCTTAGACCCTTTGCACTACATTCGAAAACCTGACTT<br>AAAAAAGAAAAGAGGGAGACCCCCTAAGATGAGGGA<br>GGCAATGGCTGAAATGCCTTTTATGCACAGCCTTAGTT<br>TTCCTCTTTCTAGTACTGGATTCTATCCATCTTATGGTAT<br>GCCTTACTCTCCTTCACCCCTTACAGCTGCTCCCATAGG<br>ATTAGGTTACTATGGAAGGTATCCTCCCACTCTTTATCC<br>ACCTCCTCCATCTCCTTCTTTCACCACGCCACTTCCACCT<br>CCTTCCTATATGCATGCTGGTCATTTACTTCTCAATCCT<br>GCCAAATACCATAAGAAAAAGCATAAGCTACTTCGACA<br>GGAGGCCTTTCTTACAACCAGCAGGACTCCCCTCCTTT<br>CCATGAGTACCTACCCCAGTGTTCCTCCTGAGATGGCC<br>TATGGTTGGATGGTTGAGCACAAACACAGGCACCGTC<br>ACAAACACAGAGAACACCGTTCTTCTGAACAACCCCAG<br>GTTTCTATGGACACTGGCTCTTCCCGATCTGTCCTGGA<br>ATCTTTGAAGCGCTATAGATTTGGAAAGGATGCTGTTG<br>GAGAGCGATATAAGCATAAGGAAAAGCACCGTTGTCA<br>CATGTCCTGCCCTCATCTCTCTCCTTCAAAAAGCTTAAT<br>AAACAGAGAGGAACAGTGGGTCCACCGAGAGCCTTCA<br>GAATCTAGTCCATTGGCCTTGGGATTGCAGACACCTTT<br>ACAGATTGACTGTTCAGAAAGTTCTCCAAGCTTATCCC<br>TTGGAGGATTCACTCCCAACTCTGAGCCAGCCAGCAGT<br>GATGAACATACAAACCTTTTCACAAGTGCAATAGGCAG<br>CTGCAGAGTTTCAAACCCTAACTCCAGTGGCCGGAAG<br>AAATTAACTGACAGCCCTGGACTCTTTTCTGCACAGGA<br>CACTTCACTAAATCGGCTTCACAGAAAGGAGTCACTGC<br>CTTCTAACGAAAGGGCAGTACAGACTTTGGCAGGCTC<br>CCAGCCAACCTCTGATAAACCCTCCCAGCGGCCATCAG<br>AGAGCACAAATTGTAGCCCTACCCGGAAAAGGTCTTC<br>ATCTGAGAGTACTTCTTCAACAGTAAACGGAGTTCCCT |

FIG. 27 Cont.

| sample | Gene Break-point 5p | Gene Break-point 3p | Frame Type | SEQ ID NO: | Fused Sequence |
|---|---|---|---|---|---|
| | | | | | CTCGAAGTCCAAGATTAGTTGCTTCTGGGGATGACTCT GTGGATAGTCTGCTGCAGCGGATGGTACAAAATGAGG ACCAAGAGCCCATGGAGAAAAGTATTGATGCTGTGAT TGCAACTGCCTCTGCACCACCTTCTTCCAGTCCAGGCC GTAGCCACAGCAAGGACCGAACCCTGGGAAAACCAGA CAGCCTTTTAGTGCCTGCAGTCACAAGTGACTCTTGCA ATAATAGCATCTCACTCCTATCTGAAAAGTTGACAAGC AGCTGTTCCCCCCATCATATCAAGAGAAGTGTAGTGGA AGCTATGCAACGCCAAGCTCGGAAAATGTGCAATTAC GACAAAATCTTGGCCACAAAGAAAAACCTAGACCATG TCAATAAAATCTTAAAAGCCAAAAAACTTCAAAGGCAG GCCAGGACAGGGAATAACTTTGTGAAACGTAGGCCAG GTCGACCTCGGAAATGTCCCCTTCAGGCTGTCGTATCA ATGCAAGCATTCCAGGCTGCTCAGTTTGTCAACCCAGA ATTGAACAGAGACGAGGAAGGAGCAGCACTGCACCTC AGTCCTGACACAGTTACAGATGTAATTGAGGCTGTTGT TCAGAGTGTAAATCTGAACCCAGAACATAAAAAGGGG TTGAAGAGAAAAGGTTGGCTATTGGAAGAACAGACCA GAAAAAAGCAGAAGCCATTACCAGAGGAAGAAGAGC AAGAGAATAATAAAAGCTTTAATGAAGCACCAGTTGA GATTCCCAGTCCTTCTGAAACCCCAGCTAAACCTTCTGA ACCTGAAAGTACCTTGCAGCCTGTGCTTTCTCTCATCCC AAGGGAAAAGAAGCCCCCACGTCCCCCAAAGAAGAAG TATCAGAAAGCAGGGCTGTATTCTGACGTTTACAAAAC TACAGA\|CTTCTCACCTGGGGCGGGTGGGTTCTGCACC ACCCTCCCACCCTCCTTCCTCCGTGTGGACGATAGAGC CACATCCAGCACCACGGACAGCTCCCGGGCGCCTTCAT CTCCTCGTCCTCCAGGCAGCACAAGCCATTGTGGAATC TCCACCAGGTGTACAGAACGGTGCCTCTGCGTCCTGCC ACTCAGGACCTCTCAAGTCCCCGATGTGATGGCTCCTC AGCATGATCAGGAgaaattccatgatcttgcttattcctgtcttggg aagtccttctccatgtctaaccaagatctatatggctatagcaccagctc tttggctcttggcttggcatggctaagttgggagACCAAAAAGAAG AATGTACTTCATCTGGTTGGGCTGGATTCCCTC |
| G17792. TCGA-28-5204-01A-01R-1850-01.4 | 100065175 | 100061309 | InFrame | 8328 | ATGAGCGGGGGCAAGAAGAAGAGTAGTTTCCAAATCA CCAGCGTCACCACGGACTATGAGGGCCCTGGGAGCCC AGGGGCTTCGGATCCCCCTACCCCACAGCCCCCAACCG GGCCCCCGCCCCGCCTGCCCAATGGGGAGCCCAGCCC CGATCCGGGGGGCAAGGGCACCCCCCGGAATGGCTCC CCACCACCTGGGGCCCCTTCCTCCCGTTTCCGGGTGGT GAAGCTGCCCCACGGCCTGGGAGAGCCTTATCGCCGC GGTCGCTGGACGTGTGTGGATGTTTATGAGCGAGACC TGGAGCCCCACAGCTTCGGCGGACTCCTGGAGGGAAT TCGAGGGGCCTCAGGGGGCGCCGGGGGCAGATCTTT GGATTCCAGGTTGGAGCTGGCCAGCCTCGGCCTGGGC GCCCCCACCCCACCGTCAGGCCTGTCTCAGGGCCCCAC CTCCTGGCTCCGTCCACCCCCCACCTCTCCTGGACCTCA GGCCCGCTCCTTCACTGGGGGACTGGGCCAGCTGGTG GTGCCCAGCAAAGCCAAGGCAGAGAAACCCCCACTGT CGGCCTCCTCACCCCAGCAGCGCCCCCAGAGCCTGAG ACCGGTGAGAGTGCGGGCACATCCCGGGCTGCCACGC CCCTGCCCTCTCTGAGGGTGGAAGCGGAGGCTGGGGG CTCAGGGGCCAGGACCCCTCCACTGTCCCGGAGGAAA GCTGTAGACATGCGGCTGCGGATGGAGTTGGGTGCTC CAGAAGAGATGGGGCAGGTGCCCCCACTTGACTCTCG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CCCCAGCTCCCCAGCCCTCTACTTCACCCACGATGCCA GCCTGGTTCACAAATCTCCAGACCCCTTCGGAGCAGTA GCAGCTCAGAAGTTCAGCCTGGCCCACTCCATGTTGGC CATCAGTGGTCACCTAGACAGCGACGATGATAGTGGC TCCGGAAGCCTGGTTGGCATTGACAACAAAATCGAGC AAGCCATG\|GTTTTCTTCTGGAGGCAAAAAATTAAACC AACCATCTCAGGACACCCTGACTCCAAGAAACACTCAT TGAAGAAGATGGAGAAGACTCTCCAGGTGGTTGAGAC TTTGAGGTTGGTCGAGCTCCCAAAAGAGGCTAAGCCC AAGTTGGGTGAGTCCCCCGAGCTGGCAGATCCCTGCG TGTTGGCCAAGACTACAGAGGAGACCGAGGTGGAGCT GGGCCAACAGGGCCAATCCCTACTGCAGCTGCCGAGG ACGGCCGTCAAGTCTGTCTCCACGCTCATGGTCTCTGC CCTGCAGAGCGGCTGGCAGATGTGCAGCTGGAAGTCA TCAGTGAGTTCTGCCTCAGTCAGCTCCCAAGTGAGGAC GCAGTCACCTTTGAAGACTCCGGAGGCTGAGTTGCTGT GGGAGGTGTACCTGGTGCTGTGGGCCGTTCGGAAACA CCTGCGCCGGCTGTACCGCAGGCAGGAGAGGCACAG ACGGCACCACGTCCGATGCCATGCTGCCCCCCGACCCA ACCCGGCTCAGTCCCTGAAACTGGATGCCCAAAGTCCC CTC |
| BT299 | 23017536 | 1256473 | InFrame | 8329 | ATGGCTCTGCGGAGGCTGGGGGCCGCGCTGCTGCTGC TGCCGCTGCTCGCCGCCGTGGAAg\|GGGCCGGCCAGG ACGTGGGCCGAAGCTGCATCCTGGTCTCCATTGCGGG CAAGAATGTCATGCTGGACTGTGGAATGCACATGGGC TTCAATGACGACCGACGCTTCCCTGACTTCTCCTACATC ACCCAGAACGGCCGCCTAACAGACTTCCTGGACTGTGT GATCATTAGCCACTTCCACCTGGACCACTGCGGGGCAC TCCCCTACTTCAGCGAGATGGTGGGCTACGACGGGCC CATCTACATGACTCACCCCACCCAGGCCATCTGCCCCAT CTTGCTGGAGGACTACCGCAAGATCGCCGTAGACAAG AAGGGCGAGGCCAACTTCTTCACCTCCCAGATGATCAA AGACTGCATGAAGAAGGTGGTGGCTGTCCACCTCCAC CAGACGGTCCAGGTAGATGATGAGCTGGAGATCAAG GCCTACTATGCAGGCCACGTGCTGGGGGCAGCCATGT TCCAGATTAAAGTGGGCTCAGAGTCTGTGGTCTACACG GGTGATTATAACATGACCCCAGACCGACACTTAGGAG CTGCCTGGATTGACAAGTGCCGCCCCAACCTGCTCATC ACAGAGTCCACGTACGCCACGACCATCCGTGACTCCAA GCGCTGCCGGGAGCGAGACTTCCTGAAGAAAGTCCAC GAGACCGTGGAGCGTGGTGGGAAGGTGCTGATACCT GTGTTCGCGCTGGGCCGCGCCCAGGAGCTCTGCATCC TCCTGGAGACCTTCTGGGAGCGCATGAACCTGAAGGT GCCCATCTACTTCTCCACGGGGCTGACCGAGAAGGCC AACCACTACTACAAGCTGTTCATCCCCTGGACCAACCA GAAGATCCGCAAGACTTTCGTGCAGAGGAACATGTTT GAGTTCAAGCACATCAAGGCCTTCGACCGGGCTTTTGC TGACAACCCAGGACCGATGGTTGTGTTTGCCACGCCA GGAATGCTGCACGCTGGGCAGTCCCTGCAGATCTTCC GGAAATGGGCCGGAAACGAAAAGAACATGGTCATCAT GCCCGGCTACTGCGTGCAGGGCACCGTCGGCCACAAG ATCCTCAGCGGGCAGCGGAAGCTCGAGATGGAGGGG CGGCAGGTGCTGGAGGTCAAGATGCAGGTGGAGTAC ATGTCATTCAGCGCACACGCGGACGCCAAGGGCATCA TGCAGCTGGTGGGCCAGGCAGAGCCGGAGAGCGTGC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TGCTGGTGCATGGCGAGGCCAAGAAGATGGAGTTCCT GAAGCAGAAGATCGAGCAGGAGCTCCGGGTCAACTG CTACATGCCGGCCAATGGCGAGACGGTGACGCTGCCC ACAAGCCCCAGCATCCCCGTAGGCATCTCGCTGGGGCT GCTGAAGCGGGAGATGGCGCAGGGGCTGCTCCCTGA GGCCAAGAAGCCTCGGCTCCTGCACGGCACCCTGATC ATGAAGGACAGCAACTTCCGGCTGGTGTCCTCAGAGC AAGCCCTCAAAGAGCTGGGTCTGGCTGAGCACCAGCT GCGCTTCACCTGCCGCGTGCACCTGCATGACACACGCA AGGAGCAGGAGACGGCATTGCGCGTCTACAGCCACCT CAAGAGCGTCCTGAAGGACCACTGTGTGCAGCACCTC CCAGACGGCTCTGTGACTGTGGAGTCCGTCCTCCTCCA GGCCGCCGCCCCTTCTGAGGACCCAGGCACCAAGGTG CTGCTGGTCTCCTGGACCTACCAGGACGAGGAGCTGG GGAGCTTCCTCACATCTCTGCTGAAGAAGGGCCTCCCC CAGGCCCCCAGC |
| G17667. TCGA-26-5134-01A-01R-1850-01.2 | 54373484 | 53494330 | InFrame | 8330 | ATGAACCAGCCAGAGTCTGCCAACGATCCTGAACCCCT GTGTGCAGTGTGTGGCCAAGCCCACTCCTTGGAGGAA AACCACTTCTACAGCTATCCAGAGGAAGTGGATGATG ACCTCATCTGCCACATCTGCCTGCAGGCTTTGCTGGAC CCCCTGGACACTCCGTGTGGACACACCTACTGCACCCT CTGCCTCACCAACTTCCTGGTGGAGAAGGACTTCTGTC CCATGGACCGCAAGCCTCTGGTTCTGCAGCACTGCAAG AAGTCCAGCATCCTGGTCAACAAACTCCTCAACAAGCT ACTGGTGACCTGCCCATTCAGGGAGCACTGCACCCAG GTGTTGCAGCGCTGTGACCTCGAGCATCACTTTCAAAC CAGCTGTAAAGGTGCCTCCCACTACGGCCTGACCAAA GATAGGAAGAGGCGCTCACAAGATGGCTGTCCAGACG GCTGTGCGAGCCTCACAGCCACGGCTCCCTCCCCAGAG GTTTCTGCAGCTGCCACCATCTCCTTAATGACAGACGA GCCTGGCCTAGACAACCCTGCCTACGTGTCCTCGGCAG AGGACGGGCAGCCAGCAATCAGCCCAGTGGACTCTGG CCGGAGCAACCGAACTAGGGCACGGCCCTTTGAGAGA TCCACTATTAGAAGCAGATCATTTAAAAAAATAAATCG AGCTTTGAGTGTTCTTCGAAGGACAAAGAGCGGGAGT GCAGTTGCCAACCATGCCGACCAGGGCAGGGAAAATT CTGAAAACACCACTGCCCCTGAAG\|TTTGGAAAACACAT GCTACTG |
| GBM-CUMC3338_L1 | 41198856 | 41192900 | InFrame | 8331 | ATGTGGCTGAAGGTGGGGGGCCTACTTCGGGGGACC GGTGGACAGCTGGGCCAGACTGTTGGTTGGCCTTGTG GGGCCCTGGGGCCTGGGCCCCACCGCTGGGGACCATG TGGAGGTTCTTGGGCCCAAAAGTTTTACCAGGATGGG CCTGGGAGAGGCCTGGGTGAGGAGGACATTCGCAGG GCACGGGAGGCCCGTCCCAGGAAGACACCCCGGCCCC AGCTGAGTGACCGCTCTCGAGAACGCAAGGTGCCTGC CTCCCGCATCAGCCGCTTGGCCAACTTTGGGGGACTGG CTGTGGGCTTGGGGCTAGGAGTACTGGCCGAGATGGC TAAGAAGTCCATGCCAGGAGGTCGTCTGCAGTCAGAG GGTGGTTCTGGGCTGGACTCCAGCCCCTTCCTGTCGGA GGCCAATGCCGAGCGGATTGTGCAGACCTTATGTACA GTTGAGGGGCCGCCCTCAAGGTTGGCCAGATGCTCA GCATCCAGGACAACAGCTTCATCAGCCCTCAGCTGCAG CACATCTTTGAGCGGGTCCGCCAGAGCGCCGACTTCAT GCCCCGCTGGCAGATGCTGagagttcttgaagaggagctcggc agggactggcaggccaaggtggcctccttggaggaggtgcccttgcC |

FIG. 27 Cont.

| sample | Gene Break-point 5p | Gene Break-point 3p | Frame Type | SEQ ID NO: | Fused Sequence |
|---|---|---|---|---|---|
| | | | | | GCTGCCTCAATTGGGCAGGTGCACCAGGGCCTGCTGA GGGACGGGACGGAGGTGGCCGTGAAGATCCAGTACC CCGGCATAGCCCAGAGCATTCAGAGCGATGTCCAGAA CCTGCTGGCGGTACTCAAGATGAGCGCGGCCCTGCCC GCGGGCCTGTTTGCCGAGCAGAGCCTGCAGGCCTTGC AGCAGGAGCTGGCTTGGGAGTGTGACTACCGTCGTGA GGCGGCTTGTGCCCAGAATTTCAGGCAGCTGCTGGCA AATGACCCCTTCTTCCGGGTCCCAGCCGTGGTTAAGGA GCTGTGCACGACACGGGTGCTGGGCATGGAGCTGGCT GGAGGGGTCCCCCTGGACCAGTGCCAGGGCCTAAGCC AGGACCTGCGGAACCAGATTTGCTTCCAGCTCCTGACG CTGTGTCTGCGGGAGCTGTTTGAGTTCCGATTCATGCA GACTGACCCCAACTGGGCCAACTTCCTGTATGATGCCT CCAGCCACCAGGTGACCCTGCTGGACTTTGGTGCAAG CCGGGAGTTTGGGACAGAGTTCACAGACCATTACATC GAGGTGGTGAAGGCTGCAGCTGATGGAGACAGAGAC TGTGTCCTGCAGAAGTCCAGGGACCTCAAATTCCTCAC AGGCTTTGAAACCAAG|GGCGGACCCCGGAGGCCTGA GCGGCACCTGCCCCCAGCCCCTGTGGGGCCCGGGG CCCCCAGAAACCTGCAGGACGGAGCCAGACGGGGCG GGCACCATGAACAAGTTACGGCAGAGCCTGCGGCGGA GGAAGCCAGCCTACGTGCCCGAGGCGTCGCGCCCGCA CCAGTGGCAGGCAGACGAGGACGCGGTGCGGAAGGG CACGTGCAGCTTCCCGGTCAGGTACCTGGGTCACGTG GAGGTAGAGGAGTCCCGGGGAATGCACGTGTGTGAA GATGCGGTGAAGAAGCTGAAGGCGATGGGCCGAAAG TCCGTGAAGTCTGTCCTGTGGGTGTCAGCCGATGGGC TCCGAGTGGTGGACGACAAAACCAAGGATCTTCTGGT CGACCAGACCATCGAAAAGGTCTCCTTTTGTGCTCCTG ACCGCAACCTGGACAAGGCTTTCTCCTATATCTGTCGT GACGGGACTACCCGCCGCTGGATCTGCCACTGTTTTCT GGCACTGAAGGACTCCGGCGAGAGGCTGAGCCACGCT GTGGGCTGTGCTTTTGCCGCCTGCCTGGAGCGAAAAC AGCGACGGGAGAAGGAATGTGGGGTCACGGCCGCCT TCGATGCCAGCCGCACCAGCTTCGCCCGCGAGGGCTC CTTCCGCCTGTCTGGGGGTGGGCGGCCTGCTGAGCGA GAGGCCCCGGACAAGAAGAAAGCAGAGGCAGCAGCT GCCCCCACTGTGGCTCCTGGCCCTGCCCAGCCTGGGCA CGTGTCCCCGACACCAGCCACCACATCCCCTGGTGAGA AGGGTGAGGCAGGCACCCCTGTGGCTGCAGGCACCAC TGCGGCCGCCATCCCCCGGCGCCATGCACCCCTGGAG CAGCTGGTTCGCCAGGGCTCCTTCCGTGGGTTCCCAGC ACTCAGCCAGAAGAACTCGCCTTTCAAACGGCAGCTG AGCCTACGGCTGAATGAGCTGCCATCCACGCTGCAGC GCCGCACTGACTTCCAGGTGAAGGGCACAGTGCCTGA GATGGAGCCTCCTGGTGCCGGCGACAGTGACAGCATC AACGCTCTGTGCACACAGATCAGTTCATCTTTTGCCAG TGCTGGAGCGCCAGCACCAGGGCCACCACCTGCCACA ACAGGGACTTCTGCCTGGGGTGAGCCCTCCGTGCCCCC TGCAGCTGCCTTCCAGCCTGGGCACAAGCGGACACCTT CAGAGGCTGAGCGATGGCTGGAGGAGGTGTCACAGG TGGCCAAGGCCcagcagcagcagcagcagcaacagcaacagca gcagcagcagcagcagcaacagcagcaagcagcCTCAGTGGCCC CAGTGCCCACCATGCCTCCTGCCCTGCAGCCTTTCCCCG CCCCCGTGGGGCCCTTTGACGCTGCACCTGCCCAAGTG |

FIG. 27 Cont.

| sample | Gene Break-point 5p | Gene Break-point 3p | Frame Type | SEQ ID NO: | Fused Sequence |
|---|---|---|---|---|---|
| | | | | | GCCGTGTTCCTGCCACCCCCACACATGCAGCCCCCTTTT GTGCCCGCCTACCCGGGCTTGGGCTACCCACCGATGCC CCGGGTGCCCGTGGTGGGCATCACACCCTCACAGATG GTGGCAAACGCCTTCTGCTCAGCCGCCCAGCTCCAGCC TCAGCCTGCCACTCTGCTTGGGAAAGCTGGGGCCTTCC CGCCCCCTGCCATACCCAGTGCCCCTGGGAGCCAGGCC CGCCCTCGCCCCAATGGGGCCCCCTGGCCCCCTGAGCC AGCGCCTGCCCCAGCTCCAGAGTTGGACCCCTTTGAGG CCCAGTGGGCGGCATTAGAAGGCAAAGCCACTGTAGA GAAACCCTCCAACCCCTTTTCTGGCGACCTGCAAAAGA CATTCGAGATTGAACTG |
| G17815, TCGA-19-5960-01A-11R-1850-01.4 | 154918048 | 154904891 | InFrame | 8332 | ATGGCCTCCTGCCCAGACTCTGATAATAGCTGGGTGCT TGCTGGCTCCGAGAGCCTGCCAGTGGAGACACTGGGC CCGGCATCCAGGATGGACCCAGAATCTGAGAGAGCCC TGCAGGCCCCTCACAGCCCCTCCAAGACAGATGGGAA AGAATTAGCTGGGACCATGGATGGAGAAGGGACGCT CTTCCAGACTGAAAGCCCTCAGTCTGGCAGCATTCTAA CAGAGGAGACTGAGGTCAAGGGCACCCTGGAAGGTG ATGTTTGTGGTGTGGAGCCTCCTGGCCCAGGAGACAC AGTAGTCCAGGGAGACCTGCAGGAGACCACCGTGGTG ACAGGCCTGGGACCAGACACACAGGACCTGGAAGGC CAGAGCCCTCCACAGAGCCTGCCTTCAACCCCCAAAGC AGCTTGGATCAGGGAGGAGGGCCGCTGCTCCAGCAGT GACGATGACACCGACGTGGACATGGAGGGTCTGCGG AGACGGCGGGGCCGGGAGGCCGGCCCACCTCAGCCC ATGGTGCCCCTGGCTGTGGAGAACCAGGCTGGGGGTG AGGGTGCAGGCGGGGAGCTGGGCATCTCCCTCAACAT GTGCCTCCTTGGGGCCCTGGTTCTGCTTGGCCTGGGG GTCCTCCTCTTCTCAGGTGGCCTCTCAGAGTCTGAGAC TGGGCCCATGGAGGAAGTGGAGCGGCAGGTCCTCCCA GACCCCGAGGTGCTGGAAGCTGTGGGGGACAGGCAG GATGGGCTAAGGGAACAGCTGCAGGCCCCAGTGCCTC CTGACAGTGTCCCCAGCCTGCAAAACATGGGTCTTCTG CTGGACAAGCTGGCCAAGGAGAACCAGGACATCCGGC TGCTGCAGGCCCAGCTGCAGGCCCAAAAGGAAGAGCT TCAGAGCCTGATGCACCAGCCCAAAGGGCTAGAGGAG GAGAATGCCCAGCTCCGGGGGCTCTGCAGCAGGGC GAAGCCTTCCAGCGGGCTCTGGAGTCAGAGCTGCAGC AGCTGCGGGCCCGGCTCCAGGGGCTGGAGGCCGACT GTGTCCGGGGCCCAGATGGGGTGTGCCTCAGTGGGG GTAGAGGCCCACAGGGTGACAAGGCCATCAGGGAGC AAGGCCCCAGGGAGCAGGAGCCAGAACTCAGCTTCCT GAAGCAGAAGGAACAGCTGGAGGCTGAGGCACAGGC ATTAAGGCAAGAGTTAGAGAGGCAGCGACGGCTGCT GGGGTCTGTACAGCAGGATCTGGAGAGGAGCTTGCA GGATGCCAGCCGCGGGGACCCAGCTCATGCTGGCTTG GCTGAGCTGGGCCACAGATTGGCCCAGAAACTGCAGG GCCTGGAGAACTGGGGCCAGGACCCTGGGGTCTCTGC CAATGCCTCAAAGGCCTGGCACCAGAAGTCCCACTTCC AGAATTCTAGGGAGTGGAGTGGAAAGGAAAAGTGGT GGGATGGGCAGAGAGACCGGAAGGCTGAGCACTGGA AACATAAGAAGGAAGAATCTGGCCGGGAAAGGAAGA AGAACTGGGGAGGTCAGGAGGACAGGGAGCCAGCAG GAAGGTGGAAGGAGGGCAGGCCAAGGGTGGAGGAG TCGGGGAGCAAGAAGGAGGGCAAGCGACAGGGCCCG |

FIG. 27 Cont.

| sample | Gene Break-point 5p | Gene Break-point 3p | Frame Type | SEQ ID NO: | Fused Sequence |
|---|---|---|---|---|---|
| | | | | | AAGGAACCCCCAAGGAAAAGTGGTAGCTTCCACTCCT CTGGAGAAAAGCAGAAGCAACCTCGGTGGAGGGAAG GGACTAAGGACAGCCATGACCCCCTGCCATCCTGGGC AGAGCTGTTGAGGCCCAAGTACCGGGCACCCCAGGGC TGCTCAGGTGTGGACGAGTGTGCCCGGCAGGAGGGC CTGACTTTCTTTGGCACAGAGCTAGCCCCAGTGCGGCA ACAGGAGCTGGCCTCTCTGCTAAGAACATACTTGGCAC GGCTGCCCTGGGCTGGGCAGCTGACCAAGGAGCTACC CCTCTCACCTGCTTTCTTTGGTGAGGATGGCATCTTCCG TCATGACCGCCTCCGCTTCCGGGATTTTGTGGATGCCC TGGAGGACAGCTTGGAGGAGGTGGCTGTGCAACAGA CAGGTGATGATGATGAAGTAGATGACTTTGAGGACTT CATCTTCAGCCACTTCTTTGGAGACAAAGCACTGAAGA AGAG\|ACTTGGAGCTGATGTCTGTGCTGTCCTCCGGCT CTCTGGTCCACTCAAGGAACAGTATGCTCAGGAGCAT GGCTTGAACTTCCAGAGACTCCTGGACACCAGCACCTA CAAGGAGGCCTTTCGGAAGGACATGATCCGCTGGGGA GAGGAGAAACGCCAGGCTGACCCAGGCTTCTTTTGCA GGAAGATTGTGGAGGGCATCTCCCAGCCCATCTGGCT GGTGAGTGACACACGGAGAGTGTCTGACATCCAGTGG TTTCGGGAGGCCTATGGGGCCGTGACGCAGACGGTCC GCGTTGTAGCGTTGGAGCAGAGCCGACAGCAGCGGG GCTGGGTGTTCACGCCAGGGGTGGACGATGCTGAGTC AGAATGTGGCCTGGACAACTTCGGGGACTTTGACTGG GTCATCGAGAACCATGGAGTTGAACAGCGCCTGGAGG AGCAGTTGGAGAACCTGATAGAATTTATCCGCTCCAGA CTT |
| G17662. TCGA-32-1970-01A-01R-1850-01.2 | 58758160 | 50285014 | InFrame | 8333 | ATGGAAGCACGTTCTATGCTGGTTCCACCCCAGGCATC TGTGTGCTTCGAGGATGTGGCTATGGCATTCACACAG GAGGAGTGGGAACAGCTGGACCTGGCCCAGAGGACA CTGTACCGAGAGGTGACACTGGAGACCTGGGAGCATA TTGTCTCCCTGGGGCTTTTCCTTTCCAAATCTGATGTGA TCTCTCAGCTGGAGCAAGAAGAGGACCTGTGCAGGGC AGAGCAGGAGGCCCCCCGAG\|GTAAGAGCAAAGAGG CGGAAATTAAGAGAATCAACAAGGAACTGGCCAACAT CCGCTCCAAGTTCAAAGGAGACAAAGCCTTGGATGGC TACAGTAAGAAAAAATATGTGTGTAAACTGCTTTTCAT CTTCCTGCTTGGCCATGACATTGACTTTGGGCACATGG AGGCTGTGAATCTGTTGAGTTCCAATAAATACACAGAG AAGCAAATAGGTTACCTGTTCATTTCTGTGCTGGTGAA CTCGAACTCGGAGCTGATCCGCCTCATCAACAACGCCA TCAAGAATGACCTGGCCAGCCGCAACCCCACCTTCATG TGCCTGGCCCTGCACTGCATCGCCAACGTGGGCAGCC GGGAGATGGGCGAGGCCTTTGCCGCTGACATCCCCCG CATCCTGGTGGCCGGGGACAGCATGGACAGTGTCAAG CAGAGTGCGGCCCTGTGCCTCCTTCGACTGTACAAGGC CTCGCCTGACCTGGTGCCCATGGGCGAGTGGACGGCG CGTGTGGTACACCTGCTCAATGACCAGCACATGGGTGT GGTCACGGCCGCCGTCAGCCTCATCACCTGTCTCTGCA AGAAGAACCCAGATGACTTCAAGACGTGCGTCTCTCTG GCTGTGTCGCGCCTGAGCCGGATCGTCTCCTCTGCCTC CACCGACCTCCAGGACTACACCTACTACTTCGTCCCAG CACCCTGGCTCTCGGTGAAGCTCCTGCGGCTGCTGCAG TGCTACCCGCCTCCAGAGGATGCGGCTGTGAAGGGGC GGCTGGTGGAATGTCTGGAGACTGTGCTCAACAAGGC |

FIG. 27 Cont.

| sample | Gene Break-point 5p | Gene Break-point 3p | Frame Type | SEQ ID NO: | Fused Sequence |
|---|---|---|---|---|---|
| | | | | | CCAGGAGCCCCCCAAATCCAAGAAGGTGCAGCATTCC<br>AACGCCAAGAACGCCATCCTCTTCGAGACCATCAGCCT<br>CATCATCCACTATGACAGTGAGCCCAACCTCCTGGTTC<br>GGGCCTGCAACCAGCTGGGCCAGTTCCTGCAGCACCG<br>GGAGACCAACCTGCGCTACCTGGCCCTGGAGAGCATG<br>TGCACGCTGGCCAGCTCCGAGTTCTCCCATGAAGCCGT<br>CAAGACGCACATTGACACCGTCATCAATGCCCTCAAGA<br>CGGAGCGGGACGTCAGCGTGCGGCAGCGGGCGGCTG<br>ACCTCCTCTACGCCATGTGTGACCGGAGCAATGCCAAG<br>CAGATCGTGTCGGAGATGCTGCGGTACCTGGAGACGG<br>CAGACTACGCCATCCGCGAGGAGATCGTCCTGAAGGT<br>GGCCATCCTGGCCGAGAAGTACGCCGTGGACTACAGC<br>TGGTACGTGGACACCATCCTCAACCTCATCCGCATTGC<br>GGGCGACTACGTGAGTGAGGAGGTGTGGTACCGTGT<br>GCTACAGATCGTCACCAACCGTGATGACGTCCAGGGC<br>TATGCCGCCAAGACCGTCTTTGAGGCGCTCCAGGCCCC<br>TGCCTGTCACGAGAACATGGTGAAGGTTGGCGGCTAC<br>ATCCTTGGGGAGTTTGGGAACCTGATTGCTGGGGACC<br>CCCGCTCCAGCCCCCCAGTGCAGTTCTCCCTGCTCCACT<br>CCAAGTTCCATCTGTGCAGCGTGGCCACGCGGGCGCT<br>GCTGCTGTCCACCTACATCAAGTTCATCAACCTCTTCCC<br>CGAGACCAAGGCCACCATCCAGGGCGTCCTGCGGGCC<br>GGCTCCCAGCTGCGCAATGCTGACGTGGAGCTGCAGC<br>AGCGAGCCGTGGAGTACCTCACCCTCAGCTCAGTGGC<br>CAGCACCGACGTCCTGGCCACGGTGCTGGAGGAGATG<br>CCGCCCTTCCCCGAGCGCGAGTCGTCCATCCTGGCCAA<br>GCTGAAACGCAAGAAGGGGCCAGGGGCCGGCAGCGC<br>CCTGGACGATGGCCGGAGGGACCCCAGCAGCAACGA<br>CATCAACGGGGGCATGGAGCCCACCCCCAGCACTGTG<br>TCGACGCCCTCGCCCTCCGCCGACCTCCTGGGGCTGCG<br>GGCAGCCCCTCCCCCGGCAGCACCCCCGGCTTCTGCAG<br>GAGCAGGGAACCTTCTGGTGGACGTCTTCGATGGCCC<br>GGCCGCCAGCCCAGCCTGGGGCCCACCCCCGAGGAG<br>GCCTTCCTCAGCGAGCTGGAGCCGCCTGCCCCCGAGA<br>GCCCCATGGCTTTGCTGGCTGACCCAGCTCCAGCTGCT<br>GACCCAGGTCCTGAGGACATCGGCCCTCCCATTCCGGA<br>AGCCGATGAGTTGCTGAATAAGTTTGTGTGTAAGAAC<br>AACGGGGTCCTGTTCGAGAACCAGCTGCTGCAGATCG<br>GAGTCAAGTCAGAGTTCCGACAGAACCTGGGCCGCAT<br>GTATCTCTTCTATGGCAACAAGACCTCGGTGCAGTTCC<br>AGAATTTCTCACCCACTGTGGTTCACCCGGGAGACCTC<br>CAGACTCATCTGGCTGTGCAGACCAAGCGCGTGGCGG<br>CGCAGGTGGACGGCGGCGCGCAGGTGCAGCAGGTGC<br>TCAATATCGAGTGCCTGCGGGACTTCCTGACGCCCCG<br>CTGCTGTCCGTGCGCTTCCGGTACGGTGGCGCCCCCA<br>GGCCCTCACCCTGAAGCTCCCAGTGACCATCAACAAGT<br>TCTTCCAGCCCACCGAGATGGCGGCCCAGGATTTCTTC<br>CAGCGCTGGAAGCAGCTGAGCCTCCCTCAACAGGAGG<br>CGCAGAAAATCTTCAAAGCCAACCACCCCATGGACGCA<br>GAAGTTACTAAGGCCAAGCTTCTGGGGTTTGGCTCTGC<br>TCTCCTGGACAATGTGGACCCCAACCCTGAGAACTTCG<br>TGGGGCGGGATCATCCAGACTAAAGCCCTGCAGGT<br>GGGCTGTCTGCTTCGGCTGGAGCCCAATGCCCAGGCC<br>CAGATGTACCGGCTGACCCTGCGCACCAGCAAGGAGC |

FIG. 27 Cont.

| sample | Gene Break-point 5p | Gene Break-point 3p | Frame Type | SEQ ID NO: | Fused Sequence |
|---|---|---|---|---|---|
| | | | | | CCGTCTCCCGTCACCTGTGTGAGCTGCTGGCACAGCAGTTC |
| NYU_E | 65557650 | 65592691 | InFrame | 8334 | ATGGCCTCGGAGAGTGGGAAGCTTTGGGGTGGCCGGTTTGTGGGTGCAGTGGACCCCATCATGGAGAAGTTCAACGCGTCCATTGCCTACGACCGGCACCTTTGGGAGGTGGATGTTCAAGGCAGCAAAGCCTACAGCAGGGGCCTGGAGAAGGCAGGGCTCCTCACCAAGGCCGAGATGGACCAGATACTCCATGGCCTAGACAAGGTGGCTGAGGAGTGGGCCCAGGGCACCTTCAAACTGAACTCCAATGATGAGGACATCCACACAGCCAATGAGCGCCGCCTGAAGGAGCTCATTGGTGCAACGGCAGGGAAGCTGCACACGGGACGGAGCCGGAATGACCAGGTGGTCACAGACCTCAGGCTGTGGATGCGGCAGACCTGCTCCACGCTCTCGGGCCTCCTCTGGGAGCTCATTAGGACCATGGTGGATCGGGCAGAGGCGGAACGTGATGTTCTCTTCCCGGGGTACACCCATTTGCAGAGGGCCCAGCCCATCCGCTGGAGCCACTGGATTCTGAGCCACGCCGTGGCACTGACCCGAGACTCTGAGCGGCTGCTGGAGGTGCGGAAGCGGATCAATGTCCTGCCCCTGGGGAGTGGGGCCATTGCAGGCAATCCCCTGGGTGTGGACCGAGAGCTGCTCCGAGCAGAACTCAACTTTGGGGCCATCACTCTCAACAGCATGGATGCCACTAGTGAGCGGGACTTTGTGGCCGAGTTCCTGTTCTGGGCTTCGCTGTGCATGACCCATCTCAGCAGGATGGCCGAGGACCTCATCCTCTACTGCACCAAGGAATTCAGCTTCGTGCAGCTCTCAGATGCCTACAGCACGGGAAGCAGCCTGATGCCCCAGAAGAAAAACCCCGACAGTTTGGAGCTGATCCGGAGCAAGGCTGGGCGTGTGTTTGGGCGGTGTGCCGGGCTCCTGATGACCCTCAAGGGACTTCCCAGCACCTACAACAAAGACTTACAGGAGGACAAGGAAGCTGTGTTTGAAGTGTCAGACACTATGAGTGCCGTGCTCCAGGTGGCCACTGGCGTCATCTCTACGCTGCAGATTCACCAAGAGAACATGGGACAGGCTCTCAGCCCCGACATGCTGGCCACTGACCTTGCCTATTACCTGGTCCGCAAAGGGATGCCATTCCGCCAGGCCCACGAGGCCTCCGGGAAAGCTGTGTTCATGGCCGAGACCAAGGGGGTCGCCCTCAACCAGCTGTCACTGCAGGAGCTGCAGACCATCAG\|GAAGGATGCCAATTCTGCGCTTCTCAGTAACTACGAGGTATTTCAGTTACTAACTGATCTGAAAGAGCAGCGTAAAGAAAGTGGAAAGAATAAACACAGCTCTGGGCAACAGAACTTGAACACTATCACCTATGAAACGTTAAAATACATATCAAAAACACCATGCAGGCACCAGAGTCCTGAAATTGTCAGAGAATTTCTCACAGCATTGAAAAGCCACAAGTTGACCAAAGCTGAGAAGCTCCAGCTGCTGAACCACCGGCCTGTGACTGCTGTGGAGATCCAGCTGATGGTGGAAGAGAGTGAAGAGCGGCTCACGGAGGAGCAGATTGAAGCTCTTCTCCACACCGTCACCAGCATTCTGCCTGCAGAGCCAGAGGCTGAGCAGAAGAAGAATACAAACAGCAATGTGGCAATGGACGAAGAGGACCCAGCA |
| G17816.TCGA-28-5215-01A-01R-1850-01.4 | 55268106 | 56079562 | InFrame | 8335 | ATGCGACCCTCCGGGACGGCCGGGGCAGCGCTCCTGGCGCTGCTGGCTGCGCTCTGCCCGGCGAGTCGGGCTCTGGAGGAAAAGAAAGTTTGCCAAGGCACGAGTAACAAGCTCACGCAGTTGGGCACTTTTGAAGATCATTTTCTCAGCCTCCAGAGGATGTTCAATAACTGTGAGGTGGTCCTTGGGAATTTGGAAATTACCTATGTGCAGAGGAATTATGATCTTTCCTTCTTAAAGACCATCCAGGAGGTGGCTGGT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TATGTCCTCATTGCCCTCAACACAGTGGAGCGAATTCC<br>TTTGGAAAACCTGCAGATCATCAGAGGAAATATGTACT<br>ACGAAAATTCCTATGCCTTAGCAGTCTTATCTAACTATG<br>ATGCAAATAAAACCGGACTGAAGGAGCTGCCCATGAG<br>AAATTTACAGGAAATCCTGCATGGCGCCGTGCGGTTCA<br>GCAACAACCCTGCCCTGTGCAACGTGGAGAGCATCCA<br>GTGGCGGGACATAGTCAGCAGTGACTTTCTCAGCAAC<br>ATGTCGATGGACTTCCAGAACCACCTGGGCAGCTGCC<br>AAAAGTGTGATCCAAGCTGTCCCAATGGGAGCTGCTG<br>GGGTGCAGGAGAGGAGAACTGCCAGAAACTGACCAA<br>AATCATCTGTGCCCAGCAGTGCTCCGGGCGCTGCCGTG<br>GCAAGTCCCCAGTGACTGCTGCCACAACCAGTGTGCT<br>GCAGGCTGCACAGGCCCCCGGGAGAGCGACTGCCTG<br>GTCTGCCGCAAATTCCGAGACGAAGCCACGTGCAAGG<br>ACACCTGCCCCCCACTCATGCTCTACAACCCCACCACGT<br>ACCAGATGGATGTGAACCCCGAGGGCAAATACAGCTT<br>TGGTGCCACCTGCGTGAAGAAGTGTCCCCGTAATTATG<br>TGGTGACAGATCACGGCTCGTGCGTCCGAGCCTGTGG<br>GGCCGACAGCTATGAGATGGAGGAAGACGGCGTCCG<br>CAAGTGTAAGAAGTGCGAAGGGCCTTGCCGCAAAGTG<br>TGTAACGGAATAGGTATTGGTGAATTTAAAGACTCACT<br>CTCCATAAATGCTACGAATATTAAACACTTCAAAAACT<br>GCACCTCCATCAGTGGCGATCTCCACATCCTGCCGGTG<br>GCATTTAGGGGTGACTCCTTCACACATACTCCTCCTCTG<br>GATCCACAGGAACTGGATATTCTGAAAACCGTAAAGG<br>AAATCACAGGGTTTTTGCTGATTCAGGCTTGGCCTGAA<br>AACAGGACGGACCTCCATGCCTTTGAGAACCTAGAAA<br>TCATACGCGGCAGGACCAAGCAACATGGTCAGTTTTCT<br>CTTGCAGTCGTCAGCCTGAACATAACATCCTTGGGATT<br>ACGCTCCCTCAAGGAGATAAGTGATGGAGATGTGATA<br>ATTTCAGGAAACAAAAATTTGTGCTATGCAAATACAAT<br>AAAACTGGAAAAAACTGTTTGGGACCTCCGGTCAGAAA<br>ACCAAAATTATAAGCAACAGAGGTGAAAACAGCTGCA<br>AGGCCACAGGCCAGGTCTGCCATGCCTTGTGCTCCCCC<br>GAGGGCTGCTGGGGCCCGGAGCCCAGGGACTGCGTC<br>TCTTGCCGGAATGTCAGCCGAGGCAGGGAATGCGTGG<br>ACAAGTGCAACCTTCTGGAGGGTGAGCCAAGGGAGTT<br>TGTGGAGAACTCTGAGTGCATACAGTGCCACCCAGAG<br>TGCCTGCCTCAGGCCATGAACATCACCTGCACAGGACG<br>GGGACCAGACAACTGTATCCAGTGTGCCCACTACATTG<br>ACGGCCCCCACTGCGTCAAGACCTGCCCGGCAGGAGT<br>CATGGGAGAAAACAACACCCTGGTCTGGAAGTACGCA<br>GACGCCGGCCATGTGTGCCACCTGTGCCATCCAAACTG<br>CACCTACGGATGCACTGGGCCAGGTCTTGAAGGCTGT<br>CCAACGAATGGGCCTAAGATCCCGTCCATCGCCACTGG<br>GATGGTGGGGCCCTCCTCTTGCTGCTGGTGGTGGCC<br>CTGGGGATCGGCCTCTTCATGCGAAGGCGCCACATCG<br>TTCGGAAGCGCACGCTGCGGAGGCTGCTGCAGGAGA<br>GGGAGCTTGTGGAGCCTCTTACACCCAGTGGAGAAGC<br>TCCCAACCAAGCTCTCTTGAGGATCTTGAAGGAAACTG<br>AATTCAAAAAGATCAAAGTGCTGGGCTCCGGTGCGTT<br>CGGCACGGTGTATAAGGGACTCTGGATCCCAGAAGGT<br>GAGAAAGTTAAAATTCCCGTCGCTATCAAGGAATTAA<br>GAGAAGCAACATCTCCGAAAGCCAACAAGGAAATCCT<br>CGATGAAGCCTACGTGATGGCCAGCGTGGACAACCCC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CACGTGTGCCGCCTGCTGGGCATCTGCCTCACCTCCAC CGTGCAGCTCATCACGCAGCTCATGCCCTTCGGCTGCC TCCTGGACTATGTCCGGGAACACAAAGACAATATTGG CTCCCAGTACCTGCTCAACTGGTGTGTGCAGATCGCAA AGGGCATGAACTACTTGGAGGACCGTCGCTTGGTGCA CCGCGACCTGGCAGCCAGGAACGTACTGGTGAAAACA CCGCAGCATGTCAAGATCACAGATTTTGGGCTGGCCA AACTGCTGGGTGCGGAAGAGAAAGAATACCATGCAG AAGGAGGCAAAGTGCCTATCAAGTGGATGGCATTGGA ATCAATTTTACACAGAATCTATACCCACCAGAGTGATG TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|GATGCT TCATTGGATTTGGAGGAAATGTGATCAGGCAACAAG TCAAGGATAACGCCAAATGTATATCACTGATTTTGTA GAGCTGCTGGGAGAACTGGAAGAA |
| G17650. TCGA-28-2513-01A-01R-1850-01.2 | 55433922 | 55914330 | InFrame | 8336 | ATGGGCGAGACCATGTCAAAGAGGCTGAAGCTCCACC TGGGAGGGGAGGCAGAAATGGAGGAACGGGCGTTCG TCAACCCCTTCCCGGACTACGAGGCCGCCGCCGGGGC GCTGCTCGCCTCCGGAGCGGCCGAAGAGACAGGCTGT GTTCGTCCCCGGCGACCACGGATGAGCCCGGCCTCCC TTTTCATCAGGACGGGAAG\|CAAAAAGAAAATAATATT CGTTGTTTAACTACGATTGGACATTTTGGTTTTGAATGT TTGCCCAATCAGTTGGTGAGCAGATCTATCCGACAAGG ATTCACTTTTAATATTCTCTGTGTGGGGGAGACTGGAA TTGGAAAATCGACACTGATAGACACATTGTTTAATACT AACTTGAAAGATAACAAATCCTCACATTTTTACTCAAAT GTTGGACTTCAAATTCAGACATATGAACTTCAGGAAAG CAATGTTCAGTTGAAATTGACTGTTGTGGAGACAGTAG GGTATGGTGATCAAATAGACAAAGAAGCCAGCTACCA ACCAATAGTTGACTACATAGATGCCCAATTTGAGGCCT ATCTTCAAGAAGAACTGAAGATTAAACGTTCCTTGTTT GAGTACCATGATTCTCGCGTCCACGTGTGTCTTTACTTC ATTTCACCTACAGGACATTCCCTGAAGTCTCTTGATCTA TTAACAATGAAGAACCTTGACAGTAAGGTGAATATTAT ACCACTGATTGCCAAAGCAGACACTATTTCTAAAAATG ATTTACAGACGTTTAAGAATAAGATAATGAGTGAATTG ATTAGCAATGGCATCCAGATATATCAGCTCCCAACAGA TGAAGAAACTGCTGCTCAAGCGAACTCCTCAGTTAGTG GGCTGTTACCCTTTGCTGTGGTAGGGAGTACAGATGA AGTGAAAGTTGGAAAAAGGATGGTCAGAGGCCGTCA CTACCCTTGGGGAGTTTTGCAAGTGGAAAATGAAAAT CACTGTGACTTCGTTAAGCTCCGAGATATGCTTCTTTGT ACCAATATGGAAAATCTAAAAGAAAAAACCCACACTCA GCACTATGAATGTTATAGGTACCAAAAACTGCAGAAA ATGGGCTTTACAGATGTGGGTCCAAACAACCAGCCAG TTAGTTTTCAAGAAATCTTTGAAGCCAAAAGACAAGAG TTCTATGATCAATGTCAGAGGGAAGAAGAAGAGTTGA AACAGAGATTTATGCAGCGAGTCAAGGAGAAAGAAGC AACATTTAAAGAAGCTGAAAAAGAGCTGCAGGACAAG TTCGAGCATCTTAAAAATGATTCAACAGGAGGAGATAA |

FIG. 27 Cont.

| sample | Gene Break-point 5p | Gene Break-point 3p | Frame Type | SEQ ID NO: | Fused Sequence |
|---|---|---|---|---|---|
| | | | | | GGAAGCTCGAGGAAGAGAAAAAACAACTGGAAGGAG AAATCATAGATTTTTATAAAATGAAAGCTGCCTCCGAA GCACTGCAGACTCAGCTGAGCACCGATACAAAGAAAG ACAAACATCGTAAGAAA |
| BT308 | 33222419 | 33303169 | InFrame | 8337 | ATGGCGGCTCCCTTGGTCCTGGTGCTGGTGGTGGCTG TGACAGTGCGGGCGGCCTTGTTCCGCTCCAGTCTGGCC GAGTTCATTTCCGAGCGGGTGGAGGTGGTGTCCCCAC TGAGCTCTTGGAAGAGAGTGGTTGAAGGCCTTTCACT GTTGGACTTGGGAGTATCTCCGTATTCTGGAGCAGTAT TTCATGAAACTCCATTAATAATATACCTCTTTCATTTCCT AATTGACTATGCTGAATTGGTGTTTATGATAACTGATG CACTCACTGCTATTGCCCTGTATTTTGCAATCCAGGACT TCAATAAAGTTGTGTTTAAAAAGCAGAAACTCCTCCTA GAACTGGACCAGTATGCCCCAGATGTGGCCGAACTCA TCCGGACCCCTATGGAAATGCGTTACATCCCTTTGAAA GTGGCCCTGTTCTATCTCTTAAAATCCTTACACGATTTTG TCTTGTGTTGCCAAGTCTACCTGTGCCATCAACAACACC CTCATTGCTTTCTTCATTTTGACTACGATAAAAG \| ACAT AACCAGTGCGGTGCAATCCAAGCGAAGAAAATCCAAG |
| G17656. TCGA-28-2514-01A-02R-1850-01.2 | 55268106 | 55588823 | InFrame | 8338 | ATGCGACCCTCCGGGACGGCCGGGGCAGCGCTCCTGG CGCTGCTGGCTGCGCTCTGCCCGGCGAGTCGGGCTCT GGAGGAAAAGAAAGTTTGCCAAGGCACGAGTAACAA GCTCACGCAGTTGGGCACTTTTGAAGATCATTTTCTCA GCCTCCAGAGGATGTTCAATAACTGTGAGGTGGTCCTT GGGAATTTGGAAATTACCTATGTGCAGAGGAATTATG ATCTTTCCTTCTTAAAGACCATCCAGGAGGTGGCTGGT TATGTCCTCATTGCCCTCAACACAGTGGAGCGAATTCC TTTGGAAAACCTGCAGATCATCAGAGGAAATATGTACT ACGAAAATTCCTATGCCTTAGCAGTCTTATCTAACTATG ATGCAAATAAAACCGGACTGAAGGAGCTGCCCATGAG AAATTTACAGGAAATCCTGCATGGCGCCGTGCGGTTCA GCAACAACCCTGCCCTGTGCAACGTGGAGAGCATCCA GTGGCGGGACATAGTCAGCAGTGACTTTCTCAGCAAC ATGTCGATGGACTTCCAGAACCACCTGGGCAGCTGCC AAAAGTGTGATCCAAGCTGTCCCAATGGGAGCTGCTG GGGTGCAGGAGAGGAGAACTGCCAGAAACTGACCAA AATCATCTGTGCCCAGCAGTGCTCCGGGCGCTGCCGTG GCAAGTCCCCAGTGACTGCTGCCACAACCAGTGTGCT GCAGGCTGCACAGGCCCCGGGAGAGCGACTGCCTG GTCTGCCGCAAATTCCGAGACGAAGCCACGTGCAAGG ACACCTGCCCCCCACTCATGCTCTACAACCCCACCACGT ACCAGATGGATGTGAACCCCGAGGGCAAATACAGCTT TGGTGCCACCTGCGTGAAGAAGTGTCCCCGTAATTATG TGGTGACAGATCACGGCTCGTGCGTCCGAGCCTGTGG GGCCGACAGCTATGAGATGGAGGAAGACGGCGTCCG CAAGTGTAAGAAGTGCGAAGGGCCTTGCCGCAAAGTG TGTAACGGAATAGGTATTGGTGAATTTAAAGACTCACT CTCCATAAATGCTACGAATATTAAACACTTCAAAAACT GCACCTCCATCAGTGGCGATCTCCACATCCTGCCGGTG GCATTTAGGGGTGACTCCTTCACACATACTCCTCCTCTG GATCCACAGGAACTGGATATTCTGAAAACCGTAAAGG AAATCACAGGGTTTTTGCTGATTCAGGCTTGGCCTGAA AACAGGACGGACCTCCATGCCTTTGAGAACCTAGAAA TCATACGCGGCAGGACCAAGCAACATGGTCAGTTTTCT CTTGCAGTCGTCAGCCTGAACATAACATCCTTGGGATT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | ACGCTCCCTCAAGGAGATAAGTGATGGAGATGTGATA<br>ATTTCAGGAAACAAAAATTTGTGCTATGCAAATACAAT<br>AAACTGGAAAAAACTGTTTGGGACCTCCGGTCAGAAA<br>ACCAAAATTATAAGCAACAGAGGTGAAAACAGCTGCA<br>AGGCCACAGGCCAGGTCTGCCATGCCTTGTGCTCCCCC<br>GAGGGCTGCTGGGGCCCGGAGCCCAGGGACTGCGTC<br>TCTTGCCGGAATGTCAGCCGAGGCAGGGAATGCGTGG<br>ACAAGTGCAACCTTCTGGAGGGTGAGCCAAGGGAGTT<br>TGTGGAGAACTCTGAGTGCATACAGTGCCACCCAGAG<br>TGCCTGCCTCAGGCCATGAACATCACCTGCACAGGACG<br>GGGACCAGACAACTGTATCCAGTGTGCCCACTACATTG<br>ACGGCCCCCACTGCGTCAAGACCTGCCCGGCAGGAGT<br>CATGGGAGAAAACAACACCCTGGTCTGGAAGTACGCA<br>GACGCCGGCCATGTGTGCCACCTGTGCCATCCAAACTG<br>CACCTACGGATGCACTGGGCCAGGTCTTGAAGGCTGT<br>CCAACGAATGGGCCTAAGATCCCGTCCATCGCCACTGG<br>GATGGTGGGGCCCTCCTCTTGCTGCTGGTGGTGGCC<br>CTGGGGATCGGCCTCTTCATGCGAAGGCGCCACATCG<br>TTCGGAAGCGCACGCTGCGGAGGCTGCTGCAGGAGA<br>GGGAGCTTGTGGAGCCTCTTACACCCAGTGGAGAAGC<br>TCCCAACCAAGCTCTCTTGAGGATCTTGAAGGAAACTG<br>AATTCAAAAAGATCAAAGTGCTGGGCTCCGGTGCGTT<br>CGGCACGGTGTATAAGGGACTCTGGATCCCAGAAGGT<br>GAGAAAGTTAAAATTCCCGTCGCTATCAAGGAATTAA<br>GAGAAGCAACATCTCCGAAAGCCAACAAGGAAATCCT<br>CGATGAAGCCTACGTGATGGCCAGCGTGGACAACCCC<br>CACGTGTGCCGCCTGCTGGGCATCTGCCTCACCTCCAC<br>CGTGCAGCTCATCACGCAGCTCATGCCCTTCGGCTGCC<br>TCCTGGACTATGTCCGGGAACACAAAGACAATATTGG<br>CTCCCAGTACCTGCTCAACTGGTGTGTGCAGATCGCAA<br>AGGGCATGAACTACTTGGAGGACCGTCGCTTGGTGCA<br>CCGCGACCTGGCAGCCAGGAACGTACTGGTGAAAACA<br>CCGCAGCATGTCAAGATCACAGATTTTGGGCTGGCCA<br>AACTGCTGGGTGCGGAAGAGAAAGAATACCATGCAG<br>AAGGAGGCAAAGTGCCTATCAAGTGGATGGCATTGGA<br>ATCAATTTTACACAGAATCTATACCCACCAGAGTGATG<br>TCTGGAGCTACGGGGTGACTGTTTGGGAGTTGATGAC<br>CTTTGGATCCAAGCCATATGACGGAATCCCTGCCAGCG<br>AGATCTCCTCCATCCTGGAGAAAGGAGAACGCCTCCCT<br>CAGCCACCCATATGTACCATCGATGTCTACATGATCAT<br>GGTCAAGTGCTGGATGATAGACGCAGATAGTCGCCCA<br>AAGTTCCGTGAGTTGATCATCGAATTCTCCAAAATGGC<br>CCGAGACCCCCAGCGCTACCTTGTCATTCAG\|TGCACA<br>GAAGCCAAAAAGCATTGCTGGTATTTCGAAGGACTCT<br>ATCCAACCTATTATATATGCCGCTCCTACGAGGACTGC<br>TGTGGCTCCAGGTGCTGTGTGCGGGCCCTCTCCATACA<br>GAGGCTGTGGTACTTCTGGTTCCTTCTGATGATGGGCG<br>TGCTTTTCTGCTGCGGAGCCGGCTTCTTCATCCGGAGG<br>CGCATGTACCCCCCGCCGCTGATCGAGGAGCCAGCCTT<br>CAATGTGTCCTACACCAGGCAGCCCCCAAATCCCGGCC<br>CAGGAGCCCAGCAGCCGGGGCCGCCCTATTACACCGA<br>CCCAGGAGGACCGGGGATGAACCCTGTCGGGAATTCC<br>ATGGCAATGGCTTTCCAGGTCCCACCCAACTCACCCCA<br>GGGGAGTGTGGCCTGCCCGCCCCCTCCAGCCTACTGC |

FIG. 27 Cont.

| sample | Gene Break-point 5p | Gene Break-point 3p | Frame Type | SEQ ID NO: | Fused Sequence |
|---|---|---|---|---|---|
| | | | | | AACACGCCTCCGCCCCCGTACGAACAGGTAGTGAAGG CCAAG |
| G17639. TCGA-12-3652-01A-01R-1849-01.2 | 33295425 | 34382867 | InFrame | 8339 | ATGGCGGAGGCGCCTCCTGTCTCAGGTACTTTTAAATT CAATACAGATGCTGCTGAATTCATTCCTCAGGAGAAAA AAAATTCTGGTCTAAATTGTGGGACTCAAAGGAGACT AGACTCTAATAGGATTGGTAGAAGAAATTACAGTTCAC CACCTCCCTGTCACCTTTCCAGGCAGGTCCCTTATGATG AAATCTCTGCTGTTCATCAGCATAGTTATCATCCGTCAG GAAGCAAACCTAAGAGTCAGCAGACGTCTTTCCAGTCC TCTCCTTGTAATAAATCGCCCAAGAGCCATGGCCTTCA GAATCAACCTTGGCAGAAATTGAGGAATGAGAAGCAC CATATCAGAGTCAAGAAAGCACAGAGTCTTGCTGAGC AGACCTCAGATACAGCTGGATTAGAGAGCTCGACCAG ATCAGAGAGTGGGACAGACCTCAGAGAGCATAGTCCT TCTGAGAGTGAGAAGGAAGTTGTGGGTGCAGATCCCA GGGGAGCAAAACCCAAAAAAGCAACACAGTTTGTATA CAGCTATGGTAGAGGACCAAAAGTCAAGGGGAAACTC AAATGTGAATGGAGTAACCGAACAACTCCAAAACCGG AGGATGCTGGACCCGAAAGTACCAAACCTGTGGGGGT TTTCCACCCTGACTCTTCAGAGGCATCCTCTAGAAAAG GAGTATTGGATGGGTATGGAGCCAGACGAAATGAGC AGAGAAGATACCCACAGAAAAGGCCTCCCTGGGAAGT GGAGGGGGCCAGGCCACGACCAGGCAGAAATCCACC AAAACAGGAGGGCCACCGACATACAAACGCAGGACAC AGAAACAACATGGGCCCCATTCCAAAGGATGACCTCA ATGAAAGACCAGCAAAATCTACCTGTGACAGTGAGAA CTTGGCAGTCATCAACAAGTCTTCCAGGAGGGTTGACC AAGAGAAATGCACTGTACGGAGGCAGGATCCTCAAGT AGTATCTCCTTTCTCCCGAGGCAAACAGAACCATGTGC TAAAGAATGTGGAAACGCACACAG\|CAGACAAATGCA GCCCAAACTACCTGGGCAGTGACTGGTACAACACATG GAGGATGGAACCTTACAACAGCAGCTGCTGCAACAAG TATACCACCTACCTTCCTCGGCTGCCTAAGGAGGCCAG GATGGAGACAGCAGTTCGAGGAATGCCCTTGGAATGC CCTCCTAGGCCGGAGCGGCTCAATGCCTACGAGCGCG AAGTGATGGTGAACATGCTGAACTCACTGTCGCGGAA CCAGCAGCTGCCGCGGATCACGCCCCGATGCGGGTGC GTGGACCCGCTGCCCGGCCGCCTGCCCTTCCATGGTTA CGAAAGTGCTTGCTCGGGCCGCCACTACTGTCTGCGCG GGATGGACTACTACGCCAGCGGGGCGCCCTGCACCGA CCGCCGCCTGCGGCCCTTGGTGCCGGGAGCAACCGACT ATGTGTACCTCCCTACGAGCACCGGCCCGGAATGCAGT GTGCTGTTACAACTCCCCCGCCGTCATACTACCCATATC CGAACCT |
| G17796. TCGA-41-5651-01A-01R-1850-01.4 | 58090156 | 57960909 | InFrame | 8340 | ATGGCGGCGGAAACGCTGCTGTCCAGTTTGTTAGGAC TGCTGCTTCGGGACTCCTGTTACCCGCAAGTCTGACC GGCGGTGTCGGGAGCCTGAACCTGGAGGAGCTGAGT GAGATGCGTTATGGGATCGAGATCCTGCCGTTGCCTGT CATGGGAGGGCAGAGCCAATCTTCGGACGTGGTGATT GTCTCCTCTAAGTACAAACAGCGCTATGAGTGTCGCCT GCCAGCTGGAGCTATTCACTTCCAGCGTGAAAGGGAG GAGGAAACACCTGCTTACCAAGGGCCTGGGATCCCTG AGTTGTTGAGCCCAATGAGAGATGCTCCCTGCTTGCTG AAGACAAAGGACTGGTGGACATATGAATTCGTTATG GACGCCACATCCAGCAATACCACATGGAAGATTCAGA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GATCAAAGGTGAAGTCCTCTATCTCGGCTACTACCAAT CAGCCTTCGACTGGGATGATGAAACAGCCAAGGCCTC CAAGCAGCATCGTCTTAAACGCTACCACAGCCAGACCT ATGGCAATGGGTCCAAGTGCGACCTTAATGGGAGGCC CCGGGAGGCCGAGGTTCGG\|GGTTGTACTGAACGCTT TGTGTCCAGCCCGGAGGAGATTCTGGATGTGATTGAT GAAGGGAAATCAAATCGTCATGTGGCTGTCACCAACA TGAATGAACACAGCTCTCGGAGCCACAGCATCTTCCTC ATCAACATCAAGCAGGAGAACATGGAAACGGAGCAG AAGCTCAGTGGGAAGCTGTATCTGGTGGACCTGGCAG GGAGTGAGAAGGTCAGCAAGACTGGAGCAGAGGGAG CCGTGCTGGACGAGGCAAAGAATATCAACAAGTCACT GTCAGCTCTGGGCAATGTGATCTCCGCACTGGCTGAG GGCACTAAAAGCTATGTTCCATATCGTGACAGCAAAAT GACAAGGATTCTCCAGGACTCTCTCGGGGGAAACTGC CGGACGACTATGTTCATCTGTTGCTCACCATCCAGTTAT AATGATGCAGAGACCAAGTCCACCCTGATGTTTGGGC AGCGGGCAAAGACCATTAAGAACACTGCCTCAGTAAA TTTGGAGTTGACTGCTGAGCAGTGgaagaagaaatatgag aaggagaaggagaagacaaaggcccagaaggagaCGATTGCGA AGCTGGAGGCTGAGCTGAGCCGGTGGCGCAATGGAG AGAATGTGCCTGAGACAGAGCGCCTGGCTGGGGAGG AGGCAGCCCTGGGAGCCGAGCTCTGTGAGGAGACCCC TGTGAATGACAACTCATCCATCGTGGTGCGCATCGCGC CCGAGGAGCGGCAGAAATACGAGGAGGAGATCCGCC GTCTCTATAAGCAGCTTGACGACAAGGATGATGAAAT CAACCAACAAAGCCAACTCATAGAGAAGCTCAAGCAG CAAATGCTGGACCAGGAAGAGCTGCTGGTGTCCACCC GAGGAGACAACGAGAAGGTCCAGCGGGAGCTGAGCC ACCTGCAATCAGAGAACGATGCCGCTAAGGATGAGGT GAAGGAAGTGCTGCAGGCCCTGGAGGAGCTGGCTGT GAACTATGACCAGAAGTCCCAGGAGGTGGAGGAGAA GAGCCAGCAGAACCAGCTTCTGGTGGATGAGCTGTCT CAGAAGGTGGCCACCATGCTGTCCCTGGAGTCTGAGT TGCAGCGGCTACAGGAGGTCAGTGGACACCAGCGAA AACGAATTGCTGAGGTGCTGAACGGGCTGATGAAGGA TCTGAGCGAGTTCAGTGTCATTGTGGGCAACGGGGAG ATTAAGCTGCCAGTGGAGATCAGTGGGGCCATCGAGG AGGAGTTCACTGTGGCCCGACTCTACATCAGCAAAATC AAATCAGAAGTCAAGTCTGTGGTCAAGCGGTGCCGGC AGCTGGAGAACCTCCAGGTGGAGTGTCACCGCAAGAT GGAAGTGACCGGGCGGGAGCTCTCATCCTGCCAGCTC CTCATCTCTCAGCATGAGGCCAAGATCCGCTCGCTTAC GGAATACATGCAGAGCGTGGAGCTAAAGAAGCGGCA CCTGGAAGAGTCCTATGACTCCTTGAGCGATGAGCTG GCCAAGCTCCAGGCCCAGGAAACTGTGCATGAAGTGG CCCTGAAGGACAAGGAGCCTGACACTCAGGATGCAGA TGAAGTGAAGAAGGCTCTGGAGCTGCAGATGGAGAG TCACCGGAGGCCCATCACCGGCAGCTGGCCCGGCTC CGGGACGAGATCAACGAGAAGCAGAAGACCATTGAT GAGCTCAAAGACCTAAATCAGAAGCTCCAGTTAGAGC TAGAGAAGCTTCAGGCTGACTACGAGAAGCTGAAGAG CGAAGAACACGAGAAGAGCACCAAGCTGCAGGGAGCT GACATTTCTGTACGAGCGACATGAGCAGTCCAAGCAG GACCTCAAGGGTCTGGAGGAGACAGTTGCCCGGGAAC |

| sample | Gene Breakpoint 5p | Gene Breakpoint 3p | Frame Type | SEQ ID NO: | Fused Sequence |
|---|---|---|---|---|---|
| | | | | | TCCAGACCCTCCACAACCTTCGCAAGCTGTTCGTTCAA GACGTCACGACTCGAGTCAAGAAAAGTGCAGAAATGG AGCCCGAAGACAGTGGGGGGATTCACTCCCAAAAGCA GAAGATTTCCTTTCTTGAGAACAACCTGGAACAGCTTA CAAAGGTTCACAAACAGCTGGTACGTGACAATGCAGA TCTGCGTTGTGAGCTTCCTAAATTGGAAAAACGACTTA GGGCTACGGCTGAGAGAGTTAAGGCCCTGGAGGGTG CACTGAAGGAGGCCAAGGAGGGCGCCATGAAGGACA AGCGCCGGTACCAGCAGGAGGTGGACCGCATCAAGG AGGCCGTTCGCTACAAGAGCTCGGGCAAACGGGGCCA TTCTGCCCAGATTGCCAAACCCGTCCGGCCTGGCCACT ACCCAGCATCCTCACCCACCAACCCCTATGGCACCCGG AGCCCTGAGTGCATCAGTTACACCAACAGCCTCTTCCA GAACTACCAGAATCTCTACCTGCAGGCCACACCCAGCT CCACCTCAGATATGTACTTTGCAAACTCCTGTACCAGC AGTGGAGCCACATCTTCTGGCGGCCCCTTGGCTTCCTA CCAGAAGGCCAACATGGACAATGGAAATGCCACAGAT ATCAATGACAATAGGAGTGACCTGCCGTGTGGCTATG AGGCTGAGGACCAGGCCAAGCTTTTCCCTCTCCACCAA GAGACAGCAGCCAGC |
| G17468. TCGA-19- 0957- 02A-11R- 2005- 01.2 | 61554352 | 90122482 | InFrame | 8341 | ATGAAGCTTGCTGACAGCGTAATGGCAGGGAAAGCTT CCGACGGCTCCATCAAATGGCAGCTCTGCTACGACATC TCGGCCAGAACTTGGTGGATGGATGAATTTCATCCTTT CATCGAAGCACTTCTGCCCCACGTCCGAGCCTTTGCCT ACACATGGTTCAACCTGCAGGCCCGAAAACGAAAATA CTTCAAAAAACATGAAAAGCGTATGTCAAAAGAAGAA GAGAGAGCCGTGAAGGATGAATTGCTAAGTGAAAAA CCAGAGGTCAAGCAGAAGTGGGCATCTCGACTTCTGG CAAAGTTGCGGAAAGATATCCGACCCGAATATCGAGA GGATTTTGTTCTTACAGTTACAGGGAAAAAACCTCCAT GTTGTGTTCTTTCCAACCCAGACCAGAAAGGCAAGATG CGAAGAATTGACTGCCTCCGCCAGGCAGATAAAGTCT GGAGGTTGGACCTTGTTATGGTGATTTTGTTTAAAGGT ATTCCGCTGGAAAGTACTGATGGCGAGCGCCTTGTAA AGTCCCCACAATGCTCTAATCCAGGGCTCTGTGTCCAA CCCCATCACATAGGGGTTTCTGTTAAGGAACTCGATTT ATATTTGGCATACTTTGTGCATGCAGCAG|TAATTAGT GAATGCCAAAGGCAGCAACTGGAGGCTGTGAGCTACT CCTCTCGATATGCTCTGGGCCTCTTTTATGAAGCTGGT ACGAAGATTGATGTCCCTTGGGCTGGGCAGTACATCA CCAGTAATCCCTGCATACGCTTCGTCTCCATTGATAATA AGAAGCGCAATATAGAGTCATCAGAAATTGGGCCTTC CCTCGTGATTCACACCACTGTCCCATTTGGAGTTACATA CTTGGAACACAGCATTGAGGATGTGCAAGAGTTAGTC TTCCAGCAGCTGGAAAACATTTTGCCGGGTTTGCCTCA GCCAATTGCTACCAAATGCCAAAAATGGAGACATTCAC AGGTTACAAATGCTGCTGCCAACTGTCCTGGCCAAATG ACTCTGCATCACAAACCTTTCCTTGCATGTGGAGGGGA TGGATTTACTCAGTCCAACTTTGATGGCTGCATCACTTC TGCCCTATGTGTTCTGGAAGCTTTAAAGAATTATATT |
| G17790. TCGA-06- 5856- 01A-01R- | 20304379 | 20987526 | InFrame | 8342 | ATGATGTTAAGAGGAAACCTGAAGCAAGTGCGCATTG AGAAAAACCCGGCCCGCCTTCGCGCCCTGGAGTCCGC GGTGGGCGAGAGCGAGCCGGCGGCCGCGGCAGCCAT GGCGCTCGCTCTTGCCGGGGAGCCGGCACCGCCCGCG CCCGCGCCTCCAGAGGACCACCCGGACGAGGAGATGG |

FIG. 27 Cont.

| sample | Gene Break-point 5p | Gene Break-point 3p | Frame Type | SEQ ID NO: | Fused Sequence |
|---|---|---|---|---|---|
| 1849-01.4 | | | | | GGTTCACTATCGACATCAAGAGTTTCCTCAAGCCGGGC GAGAAGACGTACACGCAGCGCTGCCGCCTCTTCGTGG GAAATCTGCCCACCGACATCACGGAGGAGGACTTCAA GAGGCTCTTCGAACGCTATGGCGAGCCCAGCGAAGTC TTCATCAACCGGGACCGTGGCTTCGGCTTCATCCGCTT GGAATCCAGAACCCTGGCTGAAATTGCAAAAGCAGAG CTGGACGGCACCATTCTCAAGAGCAGACCTCTACGGAT TCGCTTCGCTACACATGGAGCAGCCTTGACTGTCAAGA ACCTTTCTCCAGTTGTTTCCAATGAGCTGCTAGAGCAA GCATTTTCTCAGTTTGGTCCAGTAGAGAAAGCTGTTGT GGTTGTGGATGATCGCGGTAGAGCTACAGGAAAAGGT TTTGTAGAGTTTGCAGCAAAACCTCCTGCACGAAAGGC TCTGGAAAGATGTGGTGATGGGGCATTCTTGCTAACA ACGACCCCTCGTCCAGTCATTGTGGAACCCATGGAGCA GTTTGATGATGAAGATGGCTTGCCAGAGAAGCTGATG CAGAAAACTCAACAATATCATAAGGAAAGAGAACAAC CACCACGTTTTGCTCAACCTGGGACATTTGAATTTGAG TATGCATCTCGATGGAAGGCTCTTGATGAAATGGAAA AGCAGCAGCGTGAGCAGGTTGATAGAAACATCAGAG AAGCCAAAGAGAAACTGGAGGCAGAAATGGAAGCAG CTAGGCATGAACACCAATTAATGCTAATGAGGCAAGA TCTAATGAGGCGTCAAGAAGAACTCAGACGCTTGGAA GAACTCAGAAACCAAGAGTTGCAAAAACGGAAGCAAA TACAACTAAGACATGAAGAGGAGCATCGGCGGCGTGA GGAAGAAATGATCCGACACAGAGAACAGGAGGAACT GAGGCGACAGCAAGAGGGCTTTAAGCCAAACTACATG GAAAAT\|GAAGGAATCGTGTCTCCTAGTGACCTGGACC TTGTCATGTCAGAAGGGTTGGGCATGCGGTATGCATTC ATTGGACCCCTGGAAACCATGCATCTCAATGCAGAAG GTATGTTAAGCTACTGCGACAGATACAGCGAAGGCAT AAAACATGTCCTACAGACTTTTGGACCCATTCCAGAGT TTTCCAGGGCCACTGCTGAGAAGGTTAACCAGGACAT GTGCATGAAGGTCCCTGATGACCCGGAGCACTTAGCT GCCAGGAGGCAGTGGAGGGACGAGTGCCTCATGAGA CTCGCCAAGTTGAAGAGTCAAGTGCAGCCCCAG |
| GBM-CUMC3338_L1 | 7470322 | 7217040 | inFrame | 8343 | ATGAAAGAGACTATACAAGGGACCGGGTCCTGGGGG CCTGAGCCTCCTGGACCCGGCATACCCCCAGCTTACTC AAGTCCCAGGCGGGAGCGTCTTCGTTGGCCCCCACCTC CCAAACCCCGACTCAAGTCAGGTGGAGGGTTTGGGCC AGATCCTGGGTCAGGGACCACAGTGCCAGCCAGACGC CTCCCTGTCCCCCGACCCTCTTTTGATGCCTCAGCAAGT gaagaggaggaagaagaggaggaggaggaggatgaagatgaagag gaggaAGTGGCAGCTTGGAGGCTGCCCCCAAGATGGA GTCAGCTGGGAACCTCCCAGCGGCCCCGCCCTTCCCGC CCCACTCATCGAAAAACCTGCTCACAGCGCCGCCGCCG AGCCATGAGAGCCTTCCGGATGCTGCTCTACTCAAAAA GCACCTCGCTGACATTCCACTGGAAGCTTTgggggcgcca ccggggccggcggcggggccTCGCACACCCCAAGAACCATCT TTCACCCCAGCAAGGGGGTGCGACGCCACAGGTGCCA TCCCCCTGTTGTCGTTTTGACTCCCCCGGGGGCCACCT CCACCCCGGCTGGGTCTGCTAGGTGCTCTCATGGCTGA GGATGGGGTGAGAGGGTCTCCACCAGTGCCCTCTGGG CCCCCCATGGAGGAAGATGGACTCAGGTGGACTCCAA AGTCTCCTCTGGACCCTGACTCGGGCCTCCTTTCATGTA CTCTGCCCAACGGTTTTGGGGGACAATCTGGGCCAGA |

FIG. 27 Cont.

| sample | Gene Break-point 5p | Gene Break-point 3p | Frame Type | SEQ ID NO: | Fused Sequence |
|---|---|---|---|---|---|
| | | | | | AGGGGAGCGCAGCTTGGCACCCCCTGATGCCAGCATC CTCATCAGCAATGTGTGCAGCATCGGGGACCATGTGG CCCAGGAGCTTTTTCAGGGCTCAGATTTGGGCATGGCA GAAGAGGCAGAGAGGCCTGGGGAGAAAGCCGGCCA GCACAGCCCCTGCGAGAGGAGCATGTGACCTGCGTA CAGAGCATCTTGGACGAATTCCTTCAAACGTATGGCAG CCTCATACCCCTCAGCACTGATGAGGTAGTAGAGAAG CTGGAGGACATTTTCCAGCAGGAGTTTTCCACCCCTTC CAGGAAGGGCCTGGTGTTGCAGCTGATCCAGTCTTAC CAGCGGATGCCAGGCAATGCCATGGTGAGGGGCTTCC GAGTGGCTTATAAGCGGCACGTGCTGACCATGGATGA CTTGGGGACCTTGTATGGACAGAACTGGCTCAATGAC CAGGTGATGAACATGTATGGAGACCTGGTCATGGACA CAGTCCCTGAAAAGGTGCATTTCTTCAATAGTTTCTTCT ATGATAAACTCCGTACCAAGGGTTATGATGGGGTGAA AAGGTGGACCAAAAAC\|ACCCGGCACTACGTGGGCTC AGCAGCTGCTTTTGCAGGGACACCAGAGCATGGACAA TTCCAAGGCAGTCCTGGTGGTGCCTATGGGACTGCTCA GCCCCCACCTCACTATGGGCCCACACAGCCAGCTTATA GTCCTAGTCAGCAGCTCAGAGCTCCTTCGGCATTCCCT GCAGTGCAGTACCTATCTCAGCCACAGCCACAGCCCTA TGCTGTGCATGGCCACTTTCAGCCCACTCAGACAGGTT TCCTCCAGCCTGGTGGTGCCCTGTCCTTGCAAAAGCAG ATGGAACATGCTAACCAGCAGACTGGCTTCTCCGACTC ATCCTCTCTGCGCCCCATGCACCCCCAGGCTCTGCATCC AGCCCCTGGACTCCTTGCTTCCCCCCAGCTCCCTGTGCA GATGCAGCCAGCAGGAAAGTCGGGCTTTGCAGCTACC AGCCAACCTGGCCCTCGGCTCCCCTTCATCCAACACAG CCAGAACCCGCGATTCTACCACAAG |
| G17790. TCGA-06-5856-01A-01R-1849-01.4 | 117175595 | 69229609 | InFrame | 8344 | ATGGTGAACCTGGCGGCCATGGTGTGGCGCCGGCTTC TGCCGGAAGAGGTGGGTGCTCGCCCTGGTCTTCGGGCT GTCGCTCGTCTACTTCCTCAGCAGCACCTTCAAGCAG\| GATCTTGATGCTGGTGTAAGTGAACATTCAGGTGATTG GTTGGATCAGGATTCAGTTTCAGATCAGTTTAGTGTAG AATTTGAAGTTGAATCTCTCGACTCAGAAGATTATAGC CTTAGTGAAGAAGGACAAGAACTCTCAGATGAAGATG ATGAGGTATATCAAGTTACTGTGTATCAGGCAGGGGA GAGTGATACAGATTCATTTGAAGAAGATCCTGAAATTT CCTTAGCTGACTATTGGAAATGCACTTCATGCAATGAA ATGAATCCCCCCCTTCCATCACATTGCAACAGATGTTG GGCCCTTCGTGAGAATTGGCTTCCTGAAGATAAAGGG AAAGATAAAGGGGAAATCTCTGAGAAAGCCAAACTGG AAAACTCAACACAAGCTGAAGAGGGCTTTGATGTTCCT GATTGTAAAAAAACTATAGTGAATGATTCCAGAGAGT CATGTGTTGAGGAAAATGATGATAAAATTACACAAGC TTCACAATCACAAGAAAGTGAAGACTATTCTCAGCCAT CAACTTCTAGTAGCATTATTTATAGCAGCCAAGAAGAT GTGAAAGAGTTTGAAAGGGAAGAAACCCAAGACAAA GAAGAGAGTGTGGAATCTAGTTTGCCCCTTAATGCCAT TGAACCTTGTGTGATTTGTCAAGGTCGACCTAAAAATG GTTGCATTGTCCATGGCAAAACAGGACATCTTATGGCC TGCTTTACATGTGCAAAGAAGCTAAAGAAAAGGAATA AGCCCTGCCCAGTATGTAGACAACCAATTCAAATGATT GTGCTAACTTATTTCCCC |

FIG. 27 Cont.

| sample | Gene Breakpoint 5p | Gene Breakpoint 3p | Frame Type | SEQ ID NO: | Fused Sequence |
|---|---|---|---|---|---|
| G17802. TCGA-28-5208-01A-01R-1850-01.4 | 51203855 | 55886916 | InFrame | 8345 | ATGGACGCGCCGCGCGCCTCGGCGGCCAAGCCCCCGA CCGGGAGGAAGATGAAGGCTCGTGCTCCCCCACCTCC TGGAAAGGCTGCCACTCTGCATGTGCACAGTGACCAG AAGCCCCCCCACGATGGGGCCCTCGGGTCGCAGCAGA ACTTGGTTCGCATGAAGGAGGCGCTGAGGGCCAGCAC CATGGACGTCACCGTGGTCCTGCCTAGTGGGCTGGAG AAGAGGAGCGTGCTCAATGGGAGCCATGCGATGATG GACCTACTGGTTGAACTTTGCCTTCAGAACCACCTGAA TCCATCCCACCATGCCCTTGAAATTCGGTCTTCAGAAAC CCAACAACCTTTGAGTTTTAAGCCAAATACTTTGATTG GGACCCTGAATGTGCATACTGTGTTTCTGAAAGAAAAA GTTCCTGAAGAGAAGGTTAAGCCTGGTCCCCCTAAGG TGCCTGAGAAATCTGTGCGTTTGGTCGTGAATTACCTG CGGACACAAAAAGCTGTTGTGCGTGTGAGCCCTGAGG TTCCTCTCCAGAATATTCTCCCAGTCATTTGTGCAAAGT GTGAGGTCAGCCCAGAGCACGTGGTTCTCCTCAGGGA CAACATTGCCGGAGAGGAGCTGGAGCTGTCCAAGTCC CTGAACGAGCTCGGGATAAAGGAGCTCTACGCGTGGG ACAACAGAAGAGAAACCTTTAGGAAATCATCACTTGG CAATGATGAGACAGATAAAGAGAAGAAAAAATTTCTG GGATTTTTCAAAGTTAATAAAAGAAGCAATAGTAAGG CTGAGCAGCTCGTGCTGTCGGGTGCAGACAGCGATGA GGACACCTCCAGGGCTGCCCCAGGAAGGGGTTTGAAC GGCTGTTTAACGACCCCCAACTCCCCATCCATGCACTC ACGTTCTCTTACGCTGGGTCCATCCCTCTCGCTGGGCA GCATCTCAGGGGTGTCCGTGAAGTCGGAGATGAAGAA GCGCCGAGCCCCTCCTCCTCCAGGTTCAGGGCCACCTG TGCAAGACAAGGCATCGGAAAAG\|GGGCTGTTACCCT TTGCTGTGGTAGGGAGTACAGATGAAGTGAAAGTTGG AAAAAGGATGGTCAGAGGCCGTCACTACCCTTGGGGA GTTTTGCAAGTGGAAAATGAAAATCACTGTGACTTCGT TAAGCTCCGAGATATGCTTCTTTGTACCAATATGGAAA ATCTAAAAGAAAAAACCCACACTCAGCACTATGAATGT TATAGGTACCAAAAACTGCAGAAAATGGGCTTTACAG ATGTGGGTCCAAACAACCAGCCAGTTAGTTTTTCAAGAA ATCTTTGAAGCCAAAAGACAAGAGTTCTATGATCAATG TCAGAGGGAAGAAGAAGAGTTGAAACAGAGATTTAT GCAGCGAGTCAAGGAGAAAGAAGCAACATTTAAAGA AGCTGAAAAAGAGCTGCAGGACAAGTTCGAGCATCTT AAAATGATTCAACAGGAGGAGATAAGGAAGCTCGAG GAAGAGAAAAAACAACTGGAAGGAGAAATCATAGATT TTTATAAAATGAAAGCTGCCTCCGAAGCACTGCAGACT CAGCTGAGCACCGATACAAAGAAAGACAAACATCGTA AGAAA |
| G17210. TCGA-12-0616-01A-01R-1849-01.2 | 101176424 | 30536851 | InFrame | 8346 | ATGAAGCTGGCCCTGCTCCTGCCCTGGGCGTGTTGCTG CCTCTGCGGGTCGGCGCTGGCCACCGGCTTCCTCTATC CCTTCTCGGCCGCAGCTCTGCAGCAGCACGGCTACCCC GAGCCCGGCGCCGGCTCCCCTGGCAGCGGCTACGCGA GCCGCCGGCACTGGTGCCATCACACAGTGACACGGAC GGTGTCCTGCCAGGTGCAGAATGGCTCGGAGACGGTG GTCCAGCGCGTGTACCAGAGCTGCCGGTGGCCGGGGC CCTGCGCCAACCTCGTAAGTTACAGGACTCTGATCAGA CCCACCTACAGAGTGTCCTACCGCACGGTGACGGTGCT GGAGTGGAGATGCTGCCCTGGCTTCACCGGGAGCAAC TGTGATGAGGAATGCATGAACTGCACCCGGCTCAGTG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | ACATGAGTGAGCGACTGACCACACTGGAGGCCAAG\|A TTATTTGCATGGGTGCAAAAGAAAATGGTTTGCCGCTG GAGTATCAAGAGAAGTTAAAAGCAATAGAACCAAATG ACTATACAGGAAAGGTCTCAGAAGAAATTGAAGACAT CATCAAAAAGGGGGAAACACAAACTCTT |
| NYU_B | 233613792 | 234862561 | InFrame | 8347 | ATGGCAGCGGAAACGCAGACACTGAACTTTGGGCCTG AATGGCTCCGAGCTCTGTCCAGTGGTGGGAGTATTAC ATCCCCTCCTCTTTCTCCAGCATTGCCGAAGTATAAATT AGCAGATTATCGTTACGGCAGAGAAGAAATGTTAGCA CTTTTCCTTAAAGACAACAAGATACCTTCAGACCTTCTG GATAAAGAATTTCTGCCTATCCTCCAGGAGGAACCCCT TCCACCATTGGCTCTGGTACCCTTTACAGAAGAAGAAC AG\|CTCAAAGAAATTCTCGAATGTTCTCACCTATTAACA GTTATTAAAATGGAAGAAGCTGGGGATGAAATTGTGA GCAATGCCATCTCCTACGCTCTATACAAAGCCTTCAGC ACCAGTGAGCAAGACAAGGATAACTGGAATGGGCAG CTGAAGCTTCTGCTGGAGTGGAACCAGCTGGACTTAG CCAATGATGAGATTTTCACCAATGACCGCCGATGGGA GTCTGCTGACCTTCAAGAAGTCATGTTTACGGCTCTCA TAAAGGACAGACCCAAGTTTGTCCGCCTCTTTCTGGAG AATGGCTTGAACCTACGGAAGTTTCTCACCCATGATGT CCTCACTGAACTCTTCTCCAACCACTTCAGCACGCTTGT GTACCGGAATCTGCAGATCGCCAAGAATTCCTATAATG ATGCCCTCCTCACGTTTGTCTGGAAACTGGTTGCGAAC TTCCGAAGAGGCTTCCGGAAGGAAGACAGAAATGGCC GGGACGAGATGGACATAGAACTCCACGACGTGTCTCC TATTACTCGGCACCCCCTGCAAGCTCTCTTCATCTGGGC CATTCTTCAGAATAAGAAGGAACTCTCCAAAGTCATTT GGGAGCAGACCAGGGGCTGCACTCTGGCAGCCCTGG GAGCCAGCAAGCTTCTGAAGACTCTGGCCAAAGTGAA GAACGACATCAATGCTGCTGGGGAGTCCGAGGAGCTG GCTAATGAGTACGAGACCCGGGCTGTTGAGCTGTTCA CTGAGTGTTACAGCAGCGATGAAGACTTGGCAGAACA GCTGCTGGTCTATTCCTGTGAAGCTTGGGGTGGAAGC AACTGTCTGGAGCTGGCGGTGGAGGCCACAGACCAGC ATTTCATCGCCCAGCCTGGGGTCCAGAATTTTCTTTCTA AGCAATGGTATGGAGAGATTTCCCGAGACACCAAGAA CTGGAAGATTATCCTGTGTCTGTTTATTATACCCTTGGT GGGCTGTGGCTTTGTATCATTTAGGAAGAAACCTGTCG ACAAGCACAAGAAGCTGCTTTGGTACATATGTGGCGTTC TTCACCTCCCCCTTCGTGGTCTTCTCCTGGAATGTGGTC TTCTACATCGCCTTCCTCCTGCTGTTTGCCTACGTGCTG CTCATGGATTTCCATTCGGTGCCACACCCCCCCGAGCT GGTCCTGTACTCGCTGGTCTTTGTCCTCTTCTGTGATGA AGTGAGACAGTGGTACGTAAATGGGGTGAATTATTTT ACTGACCTGTGGAATGTGATGGACACGCTGGGGCTTT TTTACTTCATAGCAGGAATTGTATTTCGGCTCCACTCTT CTAATAAAAGCTCTTTGTATTCTGGACGAGTCATTTTCT GTCTGGACTACATTATTTTCACTCTAAGATTGATCCACA TTTTTACTGTAAGCAGAAACTTAGGACCCAAGATTATA ATGCTGCAGAGGATGCTGATCGATGTGTTCTTCTTCCT GTTCCTCTTTGCGGTGTGGATGGTGGCCTTTGGCGTGG CCAGGCAAGGGATCCTTAGGCAGAATGAGCAGCGCTG GAGGTGGATATTCCGTTCGGTCATCTACGAGCCCTACC TGGCCATGTTCGGCCAGGTGCCCAGTGACGTGGATGG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TACCACGTATGACTTTGCCCACTGCACCTTCACTGGGA<br>ATGAGTCCAAGCCACTGTGTGTGGAGCTGGATGAGCA<br>CAACCTGCCCCGGTTCCCCGAGTGGATCACCATCCCCC<br>TGGTGTGCATCTACATGTTATCCACCAACATCCTGCTG<br>GTCAACCTGCTGGTCGCCATGTTTGGCTACACGGTGGG<br>CACCGTCCAGGAGAACAATGACCAGGTCTGGAAGTTC<br>CAGAGGTACTTCCTGGTGCAGGAGTACTGCAGCCGCC<br>TCAATATCCCCTTCCCCTTCATCGTCTTCGCTTACTTCTA<br>CATGGTGGTGAAGAAGTGCTTCAAGTGTTGCTGCAAG<br>GAGAAAAACATGGAGTCTTCTGTCTGCTGTTTCAAAAA<br>TGAAGACAATGAGACTCTGGCATGGGAGGGTGTCATG<br>AAGGAAAACTACCTTGTCAAGATCAACACAAAAGCCA<br>ACGACACCTCAGAGGAAATGAGGCATCGATTTAGACA<br>ACTGGATACAAAGCTTAATGATCTCAAGGGTCTTCTGA<br>AAGAGATTGCTAATAAAATCAAA |
| G17469.<br>TCGA-06-<br>2557-<br>01A-01R-<br>1849-<br>01.2 | 55268106 | 55863785 | InFrame | 8348 | ATGCGACCCTCCGGGACGGCCGGGGCAGCGCTCCTGG<br>CGCTGCTGGCTGCGCTCTGCCCGGCGAGTCGGGCTCT<br>GGAGGAAAAGAAAGTTTGCCAAGGCACGAGTAACAA<br>GCTCACGCAGTTGGGCACTTTTGAAGATCATTTTCTCA<br>GCCTCCAGAGGATGTTCAATAACTGTGAGGTGGTCCTT<br>GGGAATTTGGAAATTACCTATGTGCAGAGGAATTATG<br>ATCTTTCCTTCTTAAAGACCATCCAGGAGGTGGCTGGT<br>TATGTCCTCATTGCCCTCAACACAGTGGAGCGAATTCC<br>TTTGGAAAACCTGCAGATCATCAGAGGAAATATGTACT<br>ACGAAAATTCCTATGCCTTAGCAGTCTTATCTAACTATG<br>ATGCAAATAAAACCGGACTGAAGGAGCTGCCCATGAG<br>AAATTTACAGGAAATCCTGCATGGCGCCGTGCGGTTCA<br>GCAACAACCCTGCCCTGTGCAACGTGGAGAGCATCCA<br>GTGGCGGGACATAGTCAGCAGTGACTTTCTCAGCAAC<br>ATGTCGATGGACTTCCAGAACCACCTGGGCAGCTGCC<br>AAAAGTGTGATCCAAGCTGTCCCAATGGGAGCTGCTG<br>GGGTGCAGGAGAGGAGAACTGCCAGAAACTGACCAA<br>AATCATCTGTGCCCAGCAGTGCTCCGGGCGCTGCCGTG<br>GCAAGTCCCCAGTGACTGCTGCCACAACCAGTGTGCT<br>GCAGGCTGCACAGGCCCCGGGAGAGCGACTGCCTG<br>GTCTGCCGCAAATTCCGAGACGAAGCCACGTGCAAGG<br>ACACCTGCCCCCACTCATGCTCTACAACCCCACCACGT<br>ACCAGATGGATGTGAACCCCGAGGGCAAATACAGCTT<br>TGGTGCCACCTGCGTGAAGAAGTGTCCCCGTAATTATG<br>TGGTGACAGATCACGGCTCGTGCGTCCGAGCCTGTGG<br>GGCCGACAGCTATGAGATGGAGGAAGACGGCGTCCG<br>CAAGTGTAAGAAGTGCGAAGGGCCTTGCCGCAAAGTG<br>TGTAACGGAATAGGTATTGGTGAATTTAAAGACTCACT<br>CTCCATAAATGCTACGAATATTAAACACTTCAAAAACT<br>GCACCTCCATCAGTGGCGATCTCCACATCCTGCCGGTG<br>GCATTTAGGGGTGACTCCTTCACACATACTCCTCCTCTG<br>GATCCACAGGAACTGGATATTCTGAAAACCGTAAAGG<br>AAATCACAGGGTTTTTGCTGATTCAGGCTTGGCCTGAA<br>AACAGGACGGACCTCCATGCCTTTGAGAACCTAGAAA<br>TCATACGCGGCAGGACCAAGCAACATGGTCAGTTTTCT<br>CTTGCAGTCGTCAGCCTGAACATAACATCCTTGGGATT<br>ACGCTCCCTCAAGGAGATAAGTGATGGAGATGTGATA<br>ATTTCAGGAAACAAAAATTTGTGCTATGCAAATACAAT<br>AAACTGGAAAAAACTGTTTGGGACCTCCGGTCAGAAA<br>ACCAAAATTATAAGCAACAGAGGTGAAAACAGCTGCA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | AGGCCACAGGCCAGGTCTGCCATGCCTTGTGCTCCCCC GAGGGCTGCTGGGGCCCGGAGCCCAGGGACTGCGTC TCTTGCCGGAATGTCAGCCGAGGCAGGGAATGCGTGG ACAAGTGCAACCTTCTGGAGGGTGAGCCAAGGGAGTT TGTGGAGAACTCTGAGTGCATACAGTGCCACCCAGAG TGCCTGCCTCAGGCCATGAACATCACCTGCACAGGACG GGGACCAGACAACTGTATCCAGTGTGCCCACTACATTG ACGGCCCCCACTGCGTCAAGACCTGCCCGGCAGGAGT CATGGGAGAAAACAACACCCTGGTCTGGAAGTACGCA GACGCCGGCCATGTGTGCCACCTGTGCCATCCAAACTG CACCTACGGATGCACTGGGCCAGGTCTTGAAGGCTGT CCAACGAATGGGCCTAAGATCCCGTCCATCGCCACTGG GATGGTGGGGCCCTCCTCTTGCTGCTGGTGGTGGCC CTGGGGATCGGCCTCTTCATGCGAAGGCGCCACATCG TTCGGAAGCGCACGCTGCGGAGGCTGCTGCAGGAGA GGGAGCTTGTGGAGCCTCTTACACCCAGTGGAGAAGC TCCCAACCAAGCTCTCTTGAGGATCTTGAAGGAAACTG AATTCAAAAAGATCAAAGTGCTGGGCTCCGGTGCGTT CGGCACGGTGTATAAGGGACTCTGGATCCCAGAAGGT GAGAAAGTTAAAATTCCCGTCGCTATCAAGGAATTAA GAGAAGCAACATCTCCGAAAGCCAACAAGGAAATCCT CGATGAAGCCTACGTGATGGCCAGCGTGGACAACCCC CACGTGTGCCGCCTGCTGGGCATCTGCCTCACCTCCAC CGTGCAGCTCATCACGCAGCTCATGCCCTTCGGCTGCC TCCTGGACTATGTCCGGGAACACAAAGACAATATTGG CTCCCAGTACCTGCTCAACTGGTGTGTGCAGATCGCAA AGGGCATGAACTACTTGGAGGACCGTCGCTTGGTGCA CCGCGACCTGGCAGCCAGGAACGTACTGGTGAAAACA CCGCAGCATGTCAAGATCACAGATTTTGGGCTGGCCA AACTGCTGGGTGCGGAAGAGAAAGAATACCATGCAG AAGGAGGCAAAGTGCCTATCAAGTGGATGGCATTGGA ATCAATTTTACACAGAATCTATACCCACCAGAGTGATG TCTGGAGCTACGGGGTGACTGTTTGGGAGTTGATGAC CTTTGGATCCAAGCCATATGACGGAATCCCTGCCAGCG AGATCTCCTCCATCCTGGAGAAAGGAGAACGCCTCCCT CAGCCACCCATATGTACCATCGATGTCTACATGATCAT GGTCAAGTGCTGGATGATAGACGCAGATAGTCGCCCA AAGTTCCGTGAGTTGATCATCGAATTCTCCAAAATGGC CCGAGACCCCCAGCGCTACCTTGTCATTCAG\|CTGCAG GACAAGTTCGAGCATCTTAAAATGATTCAACAGGAGG AGATAAGGAAGCTCGAGGAAGAGAAAAAACAACTGG AAGGAGAAATCATAGATTTTTATAAAAATGAAAGCTGCC TCCGAAGCACTGCAGACTCAGCTGAGCACCGATACAA AGAAAGACAAACATCGTAAGAAA |
| G17480. TCGA-27-1830-01A-01R-1850-01.2 | 231945029 | 230377652 | InFrame | 8349 | ATGATCACCTCGGCCGCTGGAATTATTTCTCTTCTGGAT GAAGATGAACCACAGCTTAAGGAATTTGCACTACACA AATTGAATGCAGTTGTTAATGACTTCTGGGCAGAAATT TCCGAGTCCGTAGACAAAATAGAGGTTTTATACGAAG ATGAAGGTTTCCGGAGTCGGCAGTTTGCAGCCTTAGT GGCATCTAAAGTATTTTATCACCTGGGGGCTTTTGAGG AGTCTCTGAATTATGCTCTTGGAGCAGGGGACCTCTTC AATGTCAATGATAACTCTGAATATGTGGAAACTATTAT AGCAAAATGCATTGATCACTACACCAAACAATGTGTGG AAAATGCAGATTTGCCTGAAGGAGAAAAAAACCAAT TGACCAGAGATTGGAAGGCATCGTAAATAAAATGTTC |

FIG. 27 Cont.

| sample | Gene Break-point 5p | Gene Break-point 3p | Frame Type | SEQ ID NO: | Fused Sequence |
|---|---|---|---|---|---|
| | | | | | CAGCGATGTCTAGATGATCACAAGTATAAACAGGCTAT TGGCATTGCTCTGGAGACACGAAGACTGGACGTCTTT GAAAAGACCATACTGGAGTCGAATGATGTCCCAGGAA TGTTAGCTTATAGCCTTAAGCTCTGCATGTCTTAATGC AGAATAAACAGTTTCGGAATAAAGTACTAAGAGTTCTA GTTAAAATCTACATGAACTTGGAGAAACCTGATTTCAT CAATGTTTGTCAGTGCTTAATTTTCTTAGATGATCCTCA GGCTGTGAGTGATATCTTAGAGAAACTGGTAAAGGAA GACAACCTCCTGATGGCATATCAGATTTGTTTTGATTTG TATGAAAGTGCTAGCCAGCAGTTTTTTGTCATCTGTAAT CCAGAATCTTCGAACTGTTGGCACCCCTATTGCTTCTGT GCCTGGATCCACTAATACGGGTACTGTTCCGGGATCAG AGAAAGACAGTGACTCGATGGAAACAGAAGAAAAGA CAAGCAGTGCATTTGTAGGAAAGACACCAGAAGCCAG TCCAGAGCCTAAGGACCAGACTTTGAAAATGATTAAA ATTTTAAGTGGTGAAATGGCTATTGAGTTACATCTGCA GTTCTTAATACGAAACAATAATACAGACCTCATGATTC TAAAAAACACAAAGGATGCAGTACGGAATTCTGTATG TCATACTGCAACCGTTATAGCAAACTCTTTTATGCACTG TGGGACAACCAGTGACCAGTTTCTTAGAGATAATTTGG AATGGTTAGCCAGAGCCACTAACTGGGCAAAATTTACT GCTACAGCCAGTTTGGGTGTAATTCATAAGGGTCATGA AAAAGAAGCATTACAGTTAATGGCAACATACCTTCCCA AGGATACTTCTCCAGGATCAGCCTATCAGGAAGGTGG AGGTCTCTATGCACTAGGTCTTATTCATGCCAATCATG GTGGTGATATAATTGACTATCTGCTTAATCAGCTTAAG AACGCCAGCAATGAT\|GCAACTTTTTCCTGTACCTGTG AGGAGCAGTACGTGGGTACTTTCTGTGAAGAATACGA TGCTTGCCAGAGGAAACCTTGCCAAAACAACGCGAGC TGTATTGATGCAAATGAAAAGCAAGATGGGAGCAATT TCACCTGTGTTTGCCTTCCTGGTTATACTGGAGAGCTTT GCCAGTCCAAGATTGATTACTGCATCCTAGACCCATGC AGAAATGGAGCAACATGCATTTCCAGTCTCAGTGGATT CACCTGCCAGTGTCCAGAAGGATACTTCGGATCTGCTT GTGAAGAAAAGGTGGACCCCTGCGCCTCGTCTCCGTG CCAGAACAACGGCACCTGCTATGTGGACGGGGTACAC TTTACCTGCAACTGCAGCCCGGGCTTCACAGGGCCGAC CTGTGCCCAGCTTATTGACTTCTGTGCCCTCAGCCCCTG TGCTCATGGCACGTGCCGCAGCGTGGGCACCAGCTAC AAATGCCTCTGTGATCCAGGTTACCATGGCCTCTACTG TGAGGAGGAATATAATGAGTGCCTCTCCGCTCCATGCC TGAATGCAGCCACCTGCAGGGACCTCGTTAATGGCTAT GAGTGTGTGTGCCTGGCAGAATACAAAGGAACACACT GTGAATTGTACAAGGATCCCTGCGCTAACGTCAGCTGT CTGAACGGAGCCACCTGTGACAGCGACGGCCTGAATG GCACGTGCATCTGTGCACCCGGGTTTACAGGTGAAGA GTGCGACATTGACATAAATGAATGTGACAGTAACCCCT GCCACCATGGTGGGAGCTGCCTGGACCAGCCCAATGG TTATAACTGCCACTGCCCGCATGGTTGGGTGGGAGCA AACTGTGAGATCCACCTCCAATGGAAGTCCGGGCACA TGGCGGAGAGCCTCACCAACATGCCACGGCACTCCCTC TACATCATCATTGGAGCCCTCTGCCTGGCCTTCATCCTT ATGCTGATCATCCTGATCGTGGGGATTTGCCGCATCAG CCGCATTGAATACCAGGGTTCTTCCAGGCCAGCCTATG AGGAGTTCTACAACTGCCGCAGCATCGACAGCGAGTT |

FIG. 27 Cont.

| sample | Gene Break-point 5p | Gene Break-point 3p | Frame Type | SEQ ID NO: | Fused Sequence |
|---|---|---|---|---|---|
| | | | | | CAGCAATGCCATTGCATCCATCCGGCATGCCAGGTTTG GAAAGAAATCCCGGCCTGCAATGTATGATGTGAGCCC CATCGCCTATGAAGATTACAGTCCTGATGACAAACCCT TGGTCACACTGATTAAAACTAAAGATTTG |
| G17634. TCGA-19-2625-01A-01R-1850-01.2 | 36424288 | 37967938 | InFrame | 8350 | ATGGCGGAGGGCGCCCAGCCGCATCAGCCGCCTCAGC TcgggcccggcgccgccgcccggggcATGAAGCGGGAGTCGG AGCTGGAGCTGCCGGTGCCCGGAGCGGGAGGAGACG GAGCCGATCCCGGCCTGAGCAAGCGGCCGCGCACTGA GGAGGCGGCGGCCGACGGTGGCGGCGGGATGCAG\|G GGGAACTTGAGGTTAAGAACATGGACATGAAGCCGG GGTCAACCCTGAAGATCACAGGCAGCATCGCCGATGG CACTGATGGCTTTGTAATTAATCTGGGCCAGGGGACA GACAAGCTGAACCTGCATTTCAACCCTCGCTTCAGCGA ATCCACCATTGTCTGCAACTCATTGGACGGCAGCAACT GGGGGCAAGAACAACGGGAAGATCACCTGTGCTTCAG CCCAGGGTCAGAGGTCAAGTTCACAGTGACCTTTGAG AGTGACAAATTCAAGGTGAAGCTGCCAGATGGGCACG AGCTGACTTTTCCCAACAGGCTGGGTCACAGCCACCTG AGCTACCTGAGCGTAAGGGGCGGGTTCAACATGTCCT CTTTCAAGTTAAAAGAA |
| G17654. TCGA-41-4097-01A-01R-1850-01.2 | 86313803 | 86374956 | InFrame | 8351 | ATGGACCGGCCGGGGTTCGTGGCAGCGCTGGTGGCT GGTGGGGTAGCAGGTGTTTCTGTTGACTTGATATTATT TCCTCTGGATACCATTAAAACCAGGCTGCAGAGTCCCC AAGGATTTAGTAAGGCTGGTGGTTTTCATGGAATATAT GCTGGCGTTCCTTCTGCTGCTATTGGATCCTTTCCTAAT GCTGCTGCATTTTTTATCACCTATGAATATGTGAAGTG GTTTTTTGCATGCTGATTCATCTTCATATTTGACACCTAT GAAACATATGTTGGCTGCCTCTGCTGGAGAAGTGGTT GCCTGCCTGATTCGAGTTCCATCTGAAGTGGTTAAGCA GAGGGCACAGGTATCTGCTTCTACAAGAACATTTCAGA TTTTCTCTAACATCTTATATGAAGAGGGTATCCAAGGG TTGTATCGAGGCTATAAAAGCACAGTTTTAAGAGAG\|A TAGAAGAAGTCAGAGATGCCATGGAAAATGAAATGAG AACCCAGCTTCGCCGACAGGCAGCTGCCCACACTGATC ACTTGCGAGATGTCCTTAGGGTACAAGAACAGGAATT GAAGTCTGAATTTGAGCAGAACCTGTCTGAGAAACTCT CTGAACAAGAATTACAATTTCGTCGTCTCAGTCAAGAG CAAGTTGACAACTTTACTCTGGATATAAATACTGCCTAT GCCAGACTCAGAGGAATCGAACAGGCTGTTCAGAGCC ATGCAGTTGCTGAAGAGGAAGCCAGAAAAGCCCACCA ACTCTGGCTTTCAGTGGAGGCATTAAAGTACAGCATGA AGACCTCATCTGCAGAAACACCTACTATCCCGCTGGGT AGTGCAGTTGAGGCCATCAAAGCCAACTGTTCTGATAA TGAATTCACCCAAGCTTTAACCGCAGCTATCCCTCCAG AGTCCCTGACCCGTGGGGTGTACAGTGAAGAGACCCT TAGAGCCCGTTTCTATGCTGTTCAAAAACTGGCCCGAA GGGTAGCAATGATTGATGAAACCAGAAATAGCTTGTA CCAGTACTTCCTCTCCTACCTACAGTCCCTGCTCCTATTC CCACCTCAGCAACTGAAGCCGCCCCAGAGCTCTGCCC TGAGGATATAAACACATTTAAATTACTGTCATATGCTTC CTATTGCATTGAGCATGGTGATCTGGAGCTAGCAGCA AAGTTTGTCAATCAGCTGAAGGGGGAATCCAGACGAG TGGCACAGGACTGGCTGAAGGAAGCCCGAATGACCCT AGAAACGAAACAGATAGTGGAAATCCTGACAGCATAT |

FIG. 27 Cont.

| sample | Gene Break-point 5p | Gene Break-point 3p | Frame Type | SEQ ID NO: | Fused Sequence |
|---|---|---|---|---|---|
| | | | | | GCCAGCGCCGTAGGAATAGGAACCACTCAGGTGCAGC CAGAG |
| G17485. TCGA-14-1402-02A-01R-2005-01.2 | 142166712 | 246093239 | InFrame | 8352 | ATGGGAGTCCCCAAGTTTTACAGATGGATCTCAGAGC GGTATCCCTGTCTCAGCGAAGTGGTGAAAGAGCATCA G\|GTGATCTGCAACTCTTTCACCATCTGTAATGCGGAG ATGCAGGAAGTTGGTGTTGGCCTATATCCCAGTATCTC TTTGCTCAATCACAGCTGTGACCCCAACTGTTCGATTGT GTTCAATGGGCCCCACCTCTTACTGCGAGCAGTCCGAG ACATCGAGGTGGGAGAGGAGCTCACCATCTGCTACCT GGATATGCTGATGACCAGTGAGGAGCGCCGGAAGCA GCTGAGGGACCAGTACTGCTTTGAATGTGACTGTTTCC GTTGCCAAACCCAGGACAAGGATGCTGATATGCTAAC TGGTGATGAGCAAGTATGGAAGGAAGTTCAAGAATCC CTGAAAAAAATTGAAGAACTGAAGGCACACTGGAAGT GGGAGCAGGTTCTGGCCATGTGCCAGGCAATCATAAG CAGCAATTCTGAACGGCTTCCCGATATCAACATCTACC AGCTGAAGGTGCTCGACTGCGCCATGGATGCCTGCAT CAACCTCGGCCTGTTGGAGGAAGCCTTGTTCTATGGTA CTCGGACCATGGAGCCATACAGGATTTTTTTCCCAGGA AGCCTCCCGTCAGAGGGGTTCAAGTGATGAAAGTTG GCAAACTGCAGCTACATCAAGGCATGTTTCCCCAAGCA ATGAAGAATCTGAGACTGGCTTTTGATATTATGAGAGT GACACATGGCAGAGAACACAGCCTGATTGAAGATTTG ATTCTACTTTTAGAAGAATGCGACGCCAACATCAGAGC ATCC |
| G17498. TCGA-02-2483-01A-01R-1849-01.2 | 119976637 | 332025 | InFrame | 8353 | atggccgccgccggccgccCGGCTCAgccccggccccggctcggggc tccggggcggccgAGGCTCTGCTTCCACCCGGGgccgccgc cactgctgccgctgctgctgctgttcctgctcctgctgccgccgccgccgc tgctgGCCGGCGCCACCGCCGCTGCCTCGCGGGAGCCC GACAGCCCGTGCCGGCTGAAGACCGTCACGGTGTCCA CACTGCCCGCCCTGCGGGAGAGCGACATCggctggagcg gcgcccgcgccggggccggggctgggaccggggccggagccgCCGC CGCCGCCGCGTCCCCGGGCTCTCCTGGCTCTGCCGGCA CCGCCGCCGAGTCGCGCGCCTCCTGCTCTTTGTGCGTAAC GAGCTGCCGGGGCGCATCGCGGTGCAGGACGACCTG GACAACACCGAGCTGCCCCTTCTTCACCCTGGAGATGTC TGGCACAGCAGCGGACATCTCGCTGGTGCACTGGAGA CAGCAGTGGCTGGAGAATGGCACCTTGTACTTCCACGT CTCCATGAGCAGCTCCGGGCAGCTGGCCCAAGCCACC GCCCCACTCTCCAGGAGCCCTCGGAGATTGTTGAGG AGCAGATGCACATCCTCCACATTTCTGTGATGGGTGGC CTCATCGCGCTGCTGCTGCTGCTGCTGGTGTTCACCGT GGCGCTGTACGCCCAGCGACGTTGGCAGAAGCGTCGC CGCATCCCCCAGAAGAGCGCAAGCACAGAAGCCACTC ATGAGATCCACTACATCCCATCTGTGCTGCTGGGTCCC CAGGCGCGGGAGAGCTTCCGTTCATCCCGGCTGCAAA CCCACAATTCCGTCATTGGCGTGCCCATCCGGGAGACT CCCATCCTGGATGACTATGACTGTGAGGAGGATGAGG AGCCACCTAGGCGGGCCAACCATGTCTCCCGCGAGGA CGAGTTTGGCAGCCAGGTGACCCACACTCTGGACAGT CTGGGACATCCAGGGGAAGAGAAGGTGGACTTTGAG AAGAAAG\|ACCCAAGCCTGCCCAATGTGCAGGTGACC AGGCTGACACTCCTGTCGGAACAGGCTCCGGGGCCCG TCGTCATGGATCTCACAGGGGACCTGGCTGTTCTGAAG GACCAGGTGTTTGTCCTGAAGGAAGGTGTTGATTACA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GAGTGAAGATCTCCTTCAAGGTCCACAGGGAGATTGT CAGCGGCCTCAAGTGTCTGCACCACACCTACCGCCGG GGCCTGCGCGTGGACAAGACCGTCTACATGGTGGGCA GCTATGGCCCGAGCGCCCAGGAGTATGAGTTTGTGAC TCCGGTGGAGGAAGCGCCGAGGGGTGCGCTGGTGCG GGGCCCCTATCTGGTGGTGTCCCTCTTCACCGACGATG ACAGGACGCACCACCTGTCCTGGGAGTGGGGTCTCTG CATCTGCCAGGACTGGAAGGAC |
| G17799. TCGA-06-1804-01A-01R-1849-01.4 | 61109367 | 47345631 | InFrame | 8354 | ATGCTGCGATTACAGATGACTGATGGTCATATAAGTTG CACAGCAGTAGAATTTAGTTATATGTCAAAAATAAGCC TGAACACACCACCTGGAACTAAAGTTAAGCTCTCAGGC ATTGTTGACATAAAAAATGGATTCCTGCTCTTGAATGA CTCTAACACCACAGTTCTTGGTGGTGAAGTGGAACACC TTATTGAGAAATGGGAGTTACAGAGAAGCTTATCAAA ACACAATAGAAGCAATATTGGAACTGAAGGTGGACCA CCGCCTTTTGTGCCTTTTGGACAGAAGTGTGTATCTCAT GTCCAAGTGGATAGCAGAGAACTTGATCGAAGAAAAA CATTGCAAGTTACAATGCCTGTCAAACCTACAAATGAT AATGATGAATTTGAAAAGCAAAGGACGGCTGCTATTG CTGAAGTTGCAAAGAGCAAGGAAACCAAGACATTTGG AGGAGGTGGTGGTGGTGCTAGAAGTAATCTCAATATG AATGCTGCTGGTAACCGAAATAGGGAAGTTTTACAGA AAGAAAAGTCAACCAAATCAGAGGGAAAACATGAAG GTGTCTATAGAGAACTGGTTGATGAGAAGCTCTGAA GCACATAACGGAAATGGGCTTCAGTAAGGAAGCATCG AGGCAAGCTCTTATGGATAATGGCAACAACTTAGAAG CAGCACTGAACGTACTTCTTACAAGCAATAAACAGAAA CCTGTTATGGGTCCTCCTCTGAGAGGTAGAGGAAAAG GCAGGGGGCGAATAAGATCTGAAGATGAAGAGGACC TGGGAAATGCAAGGCCATCAGCACCAAGCACATTATTT GATTTCTTGGAATCTAAAATGGGAACTTTGAATGTGGA AGAACCTAAATCACAGCCACAGCAGCTTCATCAGGGA CAATACAGATCATCAAATACTGAGCAAAATGGAGTAA AAGATAATAATCATCTGAGACATCCTCCTCGAAATGAT ACCAGGCAGCCAAGAAATGAAAAACCGCCTCGTTTTC AAAAGAGACTCCCAAAATTCAAAGTCAGTTTTAGAAGG CAGTGGATTACCTAGAAATAGAGGTTCTGAAAGACCA AGTACTTCTTCAGTATCTGAAGTATGGGCTGAAGACAG AATCAAATGTGATAGACCGTATTCTAGATATGACAGAA CTAAAGATACTTCATATCCTTTAGGTTCTCAGCATAGTG ATGGTGCTTTTAAAAAAAGAGATAACTCTATGCAAAGC AGATCAGGAAAAGGTCCCTCCTTTGCAGAGGCAAAAG AAAATCCACTTCCTCAAGGATCTGTAGATTATAATAAT CAAAAACGTGGAAAAAGAGAAAGCCAAACATCTATTC CTGATTATTTTTATGACAGGAAATCACAAACAATAAAT AATGAAGCTTTCAGTGGTATAAAAATTGAAAAACATTT TAATGTAAATACTGATTATCAGAATCCAGTTCGAAGTA ATAGTTTCATTGGTGTTCCAAATGGAGAAGTAGAAATG CCACTGAAAGGAAGACGAATAGGACCTATTAAGCCAG CAGGACCTGTCACAGCTGTACCCTGTGATGATAAAATA TTTTACAATAGTGGGCCCAAACGAAGATCTGGGCCAAT TAAGCCAGAAAAAATACTAGAATCATCTATTCCTATGG AGTATGCAAAAATGTGGAAACCTGGAGATGAATGTTT TGCACTTTATTGGGAAGACAACAAGTTTTACCGGGCAG AAGTTGAAGCCCTCCATTCTTCGGGTATGACAGCAGTT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GTTAAATTCATTGACTACGGAAACTATGAAGAGGTGCTACTGAGCAATATCAAGCCCATTCAAACAGAGGCATGG\|GGTTATGATCATAGCTACTACTTCATTGCAACCTTTATTACTGACCCACATCAGACATCATGCTAAATACCTGAATGCA |
| G17660.TCGA-06-5414-01A-01R-1849-01.2 | 61655656 | 59872567 | InFrame | 8355 | ATGGCAGATCCAGGAATGATGAGTCTTTTTGGCGAGGATGGGAATATTTTCAGTGAAGGTCTTGAAGGCCTCGGAGAATGTGGTTACCCGGAAAATCCAGTAAATCCTATGGGTCAGCAAATGCCAATAGACCAAGGCTTTGCCTCTTTACAGCCATCCCTTCATCATCCTTCAACTAATCAAAATCAAACAAAGCTGACACATTTTGATCACTATAATCAGTATGAACAACAAAAGATGCATCTGATGGATCAGCCGAACAGAATGATGAGCAACACCCCTGGGAACGGACTCGCGTCTCCGCACTCGCAGTATCACACCCCTCCCGTTCCTCAGGTGCCCCATGGTGGCAGTGGTGGCGGTCAGATGGGTGTCTACCCTGGCATGCAGAATGAGAGGCATGGGCAATCCTTTGTGGACAGCAGCTCCATGTGGGGCCCCAGGGCTGTTCAGGTACCAGACCAGATACGAGCCCCCTACCAGCAGCAGCAGCCACAGCCGCAGCCACCGCAGCCGGCTCCGTCGGGGCCCCCTGCACAGGGCCACCCTCAGCACATGCAGCAGATGGGCAGCTATATGGCACGTGGGGATTTTTCCATGCAGCAGCATGGTCAGCCACAGCAGAGGATGAGCCAGTTTTCCCAAGGCCAAGAGGGCCTCAATCAGGGAAATCCTTTTATTGCCACCTCAGGACCTGGCCACTTGTCCCACGTGCCCCAGCAGAGTCCCAGCATGGCACCTTCCTTGCGTCACTCGGTGCAGCAGTTCCATCACCACCCCTCTACTGCTCTCCATGGAGAATCCGTTGCCCACAGTCCCAGATTCTCCCCGAATCCTCCCCAACAAGGGGCTGTTAGGCCGCAAACCCTTAACTTTAGTTCTCGGAGCCAGACAGTCCCCTCTCCTACTATAAACAACTCAGGGCAGTATTCTCGATATCCTTACAGTAACCTAAATCAGGGATTAGTTAACAATACAGGGATGAATCAAAATTTAGGCCTTACAAATAATACTCCAATGAATCAGTCCGTACCAAGATACCCCAATGCTGTAGGATTCCCATCAAACAGTGGTCAAGGACTAATGCACCAGCAGCCCATCCACCCCAGTGGCTCACTTAACCAAATGAACACACAAACTATGCATCCTTCACAGCCTCAGGGAACTTATGCCTCTCCACCTCCCATGTCACCCATGAAAGCAATGAGTAATCCAGCAGGCACTCCTCCTCACAAGTCAGGCCGGGAAGTGCTGGGATACCAATGGAAGTTGGCAGTTATCCAAATATGCCCCATCCTCAGCCATCTCACCAGCCCCCTGGTGCCATGGGAATCGGACAGAGGAATATGGGCCCCAGAAACATGCAGCAGTCTCGTCCATTTATAGGCATGTCCTCGGCACCAAGGGAATTGACTGGGCACATGAGGCCAAATGGTTGTCCTGGTGTTGGCCTTGGAGACCCACAAGCAATCCAGGAACGACTGATACCTGGCCAACAACATCCTGGTCAACAGCCATCTTTTCAGCAGTTGCCAACCTGTCCTCCACTGCAGCCTCACCCGGGCTTGCACCACCAGTCTTCACCTCCACACCCTCATCACCAGCCTTGGGCACAGCTCCACCCATCACCCCAGAACACCCCGCAGAAAGTGCCTGTGCATCAG\|TTTGACGGTGAGAACATGTATATGAGCATGACAGAGCCGAGCCAGGACTATGTGCCAGCCAGCCAGTCCTACCCTGGTCCAAGCCTGGAAAGTGAAGACTTCAACATTCCACCAATTACTCCTCCTTCCCTCCCAGACCACTCGCTGGTGCACCTGAATGAAGTTGAGTCTGGTTACCATTCTCTGTGTCACCCCATGAACCATAATGGCCTGCTACCATTTC |

FIG. 27 Cont.

| sample | Gene Break-point 5p | Gene Break-point 3p | Frame Type | SEQ ID NO: | Fused Sequence |
|---|---|---|---|---|---|
| | | | | | ATCCACAAAACATGGACCTCCCTGAAATCACAGTCTCC AATATGCTGGGCCAGGATGGAACACTGCTTTCTAATTC CATTTCTGTGATGCCAGATATACGAAACCCAGAAGGA ACTCAGTACAGTTCCCATCCTCAGATGGCAGCCATGAG ACCAAGGGGCCAGCCTGCAGACATCAGGCAGCAGCCA GGAATGATGCCACATGGCCAGCTGACTACCATTAACCA GTCACAGCTAAGTGCTCAACTTGGTTTTGAATATGGGAG GAAGCAATGTTCCCCACAACTCACCATCTCCACCTGGA AGCAAGTCTGCAACTCCTTCACCATCCAGTTCAGTGCA TGAAGATGAAGGCGATGATACCTCTAAGATCAATGGT GGAGAGAAGCGGCCTGCCTCTGATATGGGGAAAAAA CCAAAAACTCCCAAAAAGAAGAAGAAGAAGGATCCCA ATGAGCCCCAGAAGCCTGTGTCTGCCTATGCGTTATTC TTTCGTGATACTCAGGCCGCCATCAAGGGCCAAAATCC AAACGCTACCTTTGGCGAAGTCTCTAAAATTGTGGCTT CAATGTGGGACGGTTTAGGAGAAGAGCAAAAACAGG TCTATAAAAAGAAAACCGAGGCTGCGAAGAAGGAGTA CCTGAAGCAACTCGCAGCATACAGAGCCAGCCTTGTAT CCAAGAGCTACAGTGAACCTGTTGACGTGAAGACATC TCAACCTCCTCAGCTGATCAATTCGAAGCCGTCGGTGT TCCATGGGCCCAGCCAGGCCCACTCGGCCCTGTACCTA AGTTCCCACTATCACCAACAACCGGGAATGAATCCTCA CCTAACTGCCATGCATCCTAGTCTCCCCAGGAACATAG CCCCCAAGCCGAATAACCAAATGCCAGTGACTGTCTCT ATAGCAAACATGGCTGTGTCCCCTCCTCCTCCCCTCCAG ATCAGCCCGCCTCTTCACCAGCATCTCAACATGCAGCA GCACCAGCCGCTCACCATGCAGCAGCCCCTTGGGAAC CAGCTCCCATGCAGGTCCAGTCTGCCTTACACTCACC CACCATGCAGCAAGGATTTACTCTTCAACCCGACTATC AGACTATTATCAATCCTACATCTACAGCTGCACAAGTT GTCACCCAGGCAATGGAGTATGTGCGTTCGGGGTGCA GAAATCCTCCCCCACAACCGGTGGACTGGAATAACGA CTACTGCAGTAGTGGGGGCATGCAGAGGGACAAAGC ACTGTACCTTACT |
| GBM-CUMC32 96_L1 | 67688936 | 55238868 | InFrame | 8356 | ATGGCGAGCGCCTCGTACCACATTTCCAATTTGCTGGA AAAAATGACATCCAGCGACAAGGACTTTAGGTTTATG GCTACAAATGATTTGATGACGGAACTGCAGAAAGATT CCATCAAGTTGGATGATGATAGTGAAAGGAAAGTAGT GAAAATGATTTTGAAGTTATTGGAAGATAAAAATGGA GAGGTACAGAATTTAGCTGTCAAATGTCTTGGTCCTTT AGTGAGTAAAGTGAAAGAATACCAAGTAGAGACAATT GTAGATACCCTCTGCACTAACATGCTTTCTGATAAAGA ACAACTTCGAGACATTTCAAGTATTGGTCTTAAAACAG TAATTGGAGAACTTCCTCCAGCTTCCAGTGGCTCTGCA TTAGCTGCTAATGTATGTAAAAAGATTACTGGACGTCT TACAAGTGCAATAGCAAAACAGGAAGATGTCTCTGTTC AGCTAGAAGCCTTGGATATTATGGCTGATATGTTGAGC AG\|ATGCACTGGGCCAGGTCTTGAAGGCTGTCCAACG AATGGGCCTAAGATCCCGTCCATCGCCACTGGGATGG TGGGGGCCCTCCTCTTGCTGCTGGTGGTGGCCCTGGG GATCGGCCTCTTCATGCGAAGGCGCCACATCGTTCGGA AGCGCACGCTGCGGAGGCTGCTGCAGGAGAGGGAGC TTGTGGAGCCTCTTACACCCAGTGGAGAAGCTCCCAAC CAAGCTCTCTTGAGGATCTTGAAGGAAACTGAATTCAA AAAGATCAAAGTGCTGGGCTCCGGTGCGTTCGGCACG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GTGTATAAGGGACTCTGGATCCCAGAAGGTGAGAAAGTTAAAATTCCCGTCGCTATCAAGGAATTAAGAGAAGCAACATCTCCGAAAGCCAACAAGGAAATCCTCGATGAAGCCTACGTGATGGCCAGCGTGGACAACCCCCACGTGTGCCGCCTGCTGGGCATCTGCCTCACCTCCACCGTGCAGCTCATCACGCAGCTCATGCCCTTCGGCTGCCTCCTGGACTATGTCCGGGAACACAAAGACAATATTGGCTCCCAGTACCTGCTCAACTGGTGTGTGCAGATCGCAAAGGGCATGAACTACTTGGAGGACCGTCGCTTGGTGCACCGCGACCTGGCAGCCAGGAACGTACTGGTGAAAACACCGCAGCATGTCAAGATCACAGATTTTGGGCTGGCCAAACTGCTGGGTGCGGAAGAGAAAGAATACCATGCAGAAGGAGGCAAAGTGCCTATCAAGTGGATGGCATTGGAATCAATTTTACACAGAATCTATACCCACCAGAGTGATGTCTGGAGCTACGGGGTGACTGTTTGGGAGTTGATGACCTTTGGATCCAAGCCATATGACGGAATCCCTGCCAGCGAGATCTCCTCCATCCTGGAGAAAGGAGAACGCCTCCCTCAGCCACCCATATGTACCATCGATGTCTACATGATCATGGTCAAGTGCTGGATGATAGACGCAGATAGTCGCCCAAAGTTCCGTGAGTTGATCATCGAATTCTCCAAAATGGCCCGAGACCCCCAGCGCTACCTTGTCATTCAGGGGGATGAAAGAATGCATTTGCCAAGTCCTACAGACTCCAACTTCTACCGTGCCCTGATGGATGAAGAAGACATGGACGACGTGGTGGATGCCGACGAGTACCTCATCCCACAGCAGGGCTTCTTCAGCAGCCCCTCCACGTCACGGACTCCCCTCCTGAGCTCTCTGAGTGCAACCAGCAACAATTCCACCGTGGCTTGCATTGATAGAAATGGGCTGCAAAGCTGTCCCATCAAGGAAGACAGCTTCTTGCAGCGATACAGCTCAGACCCCACAGGCGCCTTGACTGAGGACAGCATAGACGACACCTTCCTCCCAGTGCCTCTGTCAGAATCCTGTCTATCACAATCAGCCTCTGAACCCCGCGCCCAGCAGAGACCCACACTACCAGGACCCCCACAGCACTGCAGTGGGCAACCCCGAGTATCTCAACACTGTCCAGCCCACCTGTGTCAACAGCACATTCGACAGCCCTGCCCACTGGGCCCAGAAAGGCAGCCACCAAATTAGCCTGGACAACCCTGACTACCAGCAGGACTTCTTTCCCAAGGAAGCCAAGCCAAATGGCATCTTTAAGGGCTCCACAGCTGAAAATGCAGAATACCTAAGGGTCGCGCCACAAAGCAGTGAATTTATTGGAGCA |
| G17505.TCGA-06-2564-01A-01R-1849-01.2 | 216844 | 1282739 | inFrame | 8357 | ATGAATAACCTAAATGATCCCCCAAATTGGAATATCCGGCCTAATTCCAGGGCGGATGGTGGTGATGGAAGCAGGTGGAATTATGCCCTGTTGGTTCCAATGCTGGGATTGGCTGCTTTTC\|GGGTTGGCTGTGTTCCGGCCGCAGAGCACCGTCTGCGTGAGGAGATCCTGGCCAAGTTCCTGCACTGGCTGATGAGTGTGTACGTCGTCGAGCTGCTCAGGTCTTTCTTTTATGTCACGGAGACCACGTTTCAAAAGAACAGGCTCTTTTTCTACCGGAAGAGTGTCTGGAGCAAGTTGCAAAGCATTGGAATCAGACAGCACTTGAAGAGGGTGCAGCTGCGGGAGCTGTCGGAAGCAGAGGTCAGGCAGCATCGGGAAGCCAGGCCCGCCCTGCTGACGTCCAGACTCCGCTTCATCCCCAAGCCTGACGGGCTGCGGCCGATTGTGAACATGGACTACGTCGTGGGAGCCAGAACGTTCCGCAGAGAAAAGAGGGCCGAGCGTCTCACCTCGAGGGTGAAGGCACTGTTCAGCGTGCTCAACTACGAGCGGGCGCGGCGCCCCGGCCTCCTGGGCGCCTCTGTGCTGGGCC |

FIG. 27 Cont.

| sample | Gene Break point 5p | Gene Break point 3p | Frame Type | SEQ ID NO: | Fused Sequence |
|---|---|---|---|---|---|
| | | | | | TGGACGATATCCACAGGGCCTGGCGCACCTTCGTGCT GCGTGTGCGGGCCCAGGACCCGCCGCCTGAGCTGTAC TTTGTCAAGGTGGATGTGACGGGCGCGTACGACACCA TCCCCCAGGACAGGCTCACGGAGGTCATCGCCAGCAT CATCAAACCCCAGAACACGTACTGCGTGCGTCGGTATG CCGTGGTCCAGAAGGCCGCCCATGGGCACGTCCGCAA GGCCTTCAAGAGCCACGTCTCTACCTTGACAGACCTCC AGCCGTACATGCGACAGTTCGTGGCTCACCTGCAGGA GACCAGCCCGCTGAGGGATGCCGTCGTCATCGAGCAG AGCTCCTCCCTGAATGAGGCCAGCAGTGGCCTCTTCGA CGTCTTCCTACGCTTCATGTGCCACCACGCCGTGCGCA TCAGGGGCAAGTCCTACGTCCAGTGCCAGGGGATCCC GCAGGGCTCCATCCTCTCCACGCTGCTCTGCAGCCTGT GCTACGGCGACATGGAGAACAAGCTGTTTGCGGGGAT TCGGCGGGACGGGCTGCTCCTGCGTTTGGTGGATGAT TTCTTGTTGGTGACACCTCACCTCACCCACGCGAAAAC CTTCCTCAGGACCCTGGTCCGAGGTGTCCCTGAGTATG GCTGCGTGGTGAACTTGCGGAAGACAGTGGTGAACTT CCCTGTAGAAGACGAGGCCCTGGGTGGCACGGCTTTT GTTCAGATGCCGGCCCACGGCCTATTCCCCTGGTGCGG CCTGCTGCTGGATACCCGGACCCTGGAGGTGCAGAGC GACTACTCCAGCTATGCCCGGACCTCCATCAGAGCCAG TCTCACCTTCAACCGCGGCTTCAAGGCTGGGAGGAAC ATGCGTCGCAAACTCTTTGGGGTCTTGCGGCTGAAGTG TCACAGCCTGTTTCTGGATTTGCAGGTGAACAGCCTCC AGACGGTGTGCACCAACATCTACAAGATCCTCCTGCTG CAGGCGTACAGGTTTCACGCATGTGTGCTGCAGCTCCC ATTTCATCAGCAAGTTTGGAAGAACCCCACATTTTTCCT GCGCGTCATCTCTGACACGGCCTCCCTCTGCTACTCCAT CCTGAAAGCCAAGAACGCAGGGATGTGCTGGGGGC CAAGGGCGCCGCCGGCCCTCTGCCCTCCGAGGCCGTG CAGTGGCTGTGCCACCAAGCATTCCTGCTCAAGCTGAC TCGACACCGTGTCACCTACGTGCCACTCCTGGGGTCAC TCAGGACAGCCCAGACGCAGCTGAGTCGGAAGCTCCC GGGGACGACGCTGACTGCCCTGGAGGCCGCAGCCAAC CCGGCACTGCCCTCAGACTTCAAGACCATCCTGGAC |
| G17798. TCGA-32- 5222- 01A-01R- 1850- 01.4 | 11313896 | 6880241 | InFrame | 8358 | ATGCTTGGAACCGGACCTGCCGCCGCCACCACCGCTGC CACCACATCTAGCAATGTGAGCGTCCTGCAGCAGTTTG CCAGTGGCCTAAAGAGCCGGAATGAGGAAAACCAGGG CCAAAGCCGCCAAGGCTCCAGCACTATGTCACCAT GGAACTCCGAGAGATGAGTCAAGAGGAGTCTACTCGC TTCTATGACCAACTGAACCATCACATTTTTGAATTGGTT TCCAGCTCAGATGCCAATGAGAGGAAAGGTGGCATCT TGGCCATAGCTAGCCTCATAGGAGTGGAAGGTGGGAA TGCCACCCGAATTGGCAGATTTGCCAACTATCTTCGGA ACCTCCTCCCCTCCAATGACCCAGTTGTCATGGAAATG GCATCCAAGGCCATTGGCCGTCTTGCCATGGCAGGGG ACACTTTTACCGCTGAGTACGTGGAATTTGAGGTGAAG CGAGCCCTGGAATGGCTGGGTGCTGACCGCAATGAGG GCCGGAGACATGCAGCTGTCCTGGTTCCGTGAGCT GGCCATCAGCGTCCCTACCTTCTTCTTCCAGCAAGTGC AACCCTTCTTTGACAACATTTTTGTGGCCGTGTGGGAC CCCAAACAGGCCATCCGTGAGGGAGCTGTAGCCGCCC TTCGTGCCTGTCTGATTCTCACAACCCAGCGTGAGCCG AAGGAGATGCAGAAGCCTCAGTGGTACAGGCACACAT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | TTGAAGAAGCAGAGAAGGGATTTGATGAGACCTTGGC CAAAGAGAAGGGCATGAATCGGGATGATCGGATCCAT GGAGCCTTGTTGATCCTTAACGAGCTGGTCCGAATCAG CAGCATGGAGGGAGAG\|agcgtttcccaaagtgtattctgcgg aacTAGCACCTACTGTGTTCTCAACACCGTGCCACCTAT AGAAGATGATCATGGGAACAGCAATAGTAGTCATGTA AAAATCTTTTTACCGAAAAAGCTGCTTGAATGTCTGCC GAAATGTTCAAGTTTACCAAAAGAGAGGCACCGCTGG AACACTAATGAGGAAATTGCAGCTTATTTAATAACATT TGAGAAACACGAAGAATGGCTAACCACCTCCCCTAAG ACAAGACCACAGAATGGCTCAATGATACTCTACAACAG GAAGAAAGTGAAATACAGGAAAGATGGGTATTGCTG GAAAAAGAGGAAAGATGGGAAAACGACCAGAGAGGA CCACATGAAACTCAAGGTCCAGGGAGTGGAGTGCTTG TACGGCTGCTATGTCCATTCCTCCATCATCCCCACCTTC CACCGGAGGTGCTACTGGCTCCTTCAGAACCCCGACAT CGTCCTGGTGCACTACCTGAACGTGCCGGCCATCGAG GACTGCGGCAAGCCTTGCGGCCCCATCCTCTGCTCCAT CAACACCGACAAGAAGGAGTGGGCGAAATGGACGAA AGAAGAGCTCATCGGGCAGCTGAAACCCATGTTCCAT GGCATCAAGTGGACCTGCAGCAATGGGAACAGCAGCT CAGGCTTCTCGGTGGAACAGCTGGTGCAGCAGATCCT CGACAGCCACCAGACCAAGCCCCAGCCGCGGACCCAC AACTGCCTCTGCACCGGCAGCCTGGGAGCTGGCGGCA GCGTGCATCACAAGTGTAACAGCGCCAAACACCGCAT CATCTCGCCCAAGGTGGAGCCACGGACAGGGGGGTAC GGGAGCCACTCGGAGGTGCAGCACAATGACGTGTCG GAGGGCAAGCACGAGCACGCCACAGCAAGGGCTCC AGCCGTGAGAAGAGGAACGGCAAGGTGGCCAAGCCC GTGCTCCTGCACCAGAGCAGCACCGAGGTCTCCTCCAC CAACCAGGTGGAAGTCCCCGACACCACCCAGAGCTCC CCTGTGTCCATCAGCAGCGGGCTCAACAGCGACCCGG ACATGGTGGACAGCCCGGTGGTCACAGGTGTGTCGG TATGGCGGTGGCCTCTGTGATGGGGAGCTTGTCCCAG AGCGCCACGGTGTTCATGTCAGAGGTCACCAATGAGG CCGTGTACACCATGTCCCCCACCGCTGGCCCCAACCAC CACCTCCTCTCACCTGACGCCTCTCAGGGCCTCGTCCTG GCCGTGAGCTCTGATGGCCACAAGTTCGCCTTTCCCAC CACGGGCAGCTCGGAGAGCCTGTCCATGCTGCCCACC AACGTGTCCGAAGAGCTGGTCCTCTCCACCACCCCTCGA CGGTGGCCGGAAGATTCCAGAAACCACCATGAACTTT GACCCCGACTGTTTCCTTAATAACCCAAAGCAGGGCCA GACGTACGGGGGTGGAGGCCTGAAAGCCGAGATGGT CAGCTCCAACATCCGGCACTCGCCACCCGGGGAGCGG AGCTTCAGCTTTACCACCGTCCTCACCAAGGAGATCAA GACCGAGGACACCTCCTTCGAGCAGCAGATGGCCAAA GAAGCGTACTCCTCCTCCGCGGCGGCTGTGGCAGCCA GCTCCCTCACCCTGACCGCCGGCTCCAGCCTCCTGCCG TCGGGCGGCGGCCTGAGTCCCAGCACCACCCTGGAGC AGATGGACTTCAGCGCCATCGACTCCAACAAGGACTA CACGTCCAGCTTCAGCCAGACGGGCCACAGCCCCCAC ATCCACCAGACCCCCTCCCCGAGCTTCTTCCTGCAGGA CGCCAGCAAACCCCTCCCCGTCGAGCAGAACACCCACA GCAGCCTGAGTGACTCTGGGGGCACCTTCGTGATGCC CACGGTGAAAACGGAGGCCTCGTCCCAAACCAGCTCC |

FIG. 27 Cont.

| sample | Gene Break-point 5p | Gene Break-point 3p | Frame Type | SEQ ID NO: | Fused Sequence |
|---|---|---|---|---|---|
| | | | | | TGCAGCGGTCACGTGGAGACGCGGATCGAGTCCACTT<br>CCTCCCTCCACCTCATGCAGTTCCAGGCCAACTTCCAG<br>GCCATGACGGCAGAAGGGGAGGTCACCATGGAGACC<br>TCGCAGGCGGCGGAAGGGAGCGAGGTCCTGCTCAAG<br>TCTGGGGAGCTGCAGGCTTGCAGCTCTGAGCACTACCT<br>GCAGCCGGAGACCAACGGGGTAATCCGAAGCGCCGG<br>CGGCGTCCCCATCCTCCCGGGCAACGTGGTGCAGGGA<br>CTCTACCCCGTGGCCCAGCCCAGCCTCGGCAACGCCTC<br>CAACATGGAGCTCAGCCTGGACCACTTTGACATCTCCT<br>TCAGCAACCAGTTCTCCGACCTGATCAACGACTTCATCT<br>CCGTGGAGGGGGGCAGCAGCACCATCTATGGGCACCA<br>GCTGGTGTCGGGGACAGCACGGCGCTCTCACAGTCA<br>GAGGACGGGGCGCGGGCCCCCTTCACCCAGGCAGAG<br>ATGTGCCTCCCCTGCTGTAGCCCCCAGCAGGGTAGCCT<br>GCAGCTGAGCAGCTCGGAGGGCGGGGCCAGCACCAT<br>GGCCTACATGCACGTCGCCGAGGTGGTCTCGGCCGCC<br>TCGGCCCAGGGCACCCTAGGCATGCTGCAGCAGAGCG<br>GACGGGTGTTCATGGTGACCGACTACTCCCCAGAGTG<br>GTCTTACCCAGAGGGAGGAGTGAAGGTCCTCATCACA<br>GGCCCGTGGCAAGAAGCCAGCAATAACTACAGCTGCC<br>TGTTTGACCAGATCTCAGTGCCTGCATCCCTGATTCAG<br>CCTGGGGTGCTGCGCTGCTACTGCCCAGCCCATGACAC<br>TGGTCTTGTGACCCTACAAGTTGCCTTCAACAACCAGA<br>TCATCTCCAACTCGGTGGTGTTTGAGTACAAAGCCCGG<br>GCTCTGCCCACGCTCCCTTCCTCCCAGCACGACTGGCT<br>GTCGTTGGACGATAACCAGTTCAGGATGTCCATCCTGG<br>AACGACTGGAGCAGATGGAGAGGAGGATGGCCGAGA<br>TGACGGGTCCCAGCAGCACAAACAGGCGAGCGGAG<br>GCGGCAGCAGTGGAGGCGGCAGCGGGAGCGGGAAT<br>GGAGGGAGCCAGGCACAGTGTGCTTCTGGGACTGGG<br>GCCTTGGGGAGCTGCTTTGAGAGCCGTGTGGTCGTGG<br>TATGCGAGAAGATGATGAGCCGAGCCTGCTGGGCGAA<br>GTCCAAGCACTTGATCCACTCAAAGACTTTCCGCGGAA<br>TGACCCTACTCCACCTGGCCGCTGCCCAGGGCTATGCC<br>ACCCTAATCCAGACCCTCATCAAATGGCGTACAAAGCA<br>CGCGGATAGCATTGACCTGGAACTGGAAGTTGACCCC<br>TTGAATGTGGACCACTTCTCCTGTACTCCTCTGATGTG<br>GGCGTGTGCCCTAGGGCACTTGGAAGCTGCCGTCGTG<br>CTGTACAAGTGGGACCGTCGGGCCATCTCGATTCCCGA<br>CTCTCTAGGAAGGCTGCCTTTGGGAATTGCCAGGTCAC<br>GGGGTCATGTGAAATTAGCAGAGTGTCTGGAGCACCT<br>GCAGAGAGATGAGCAGGCTCAGCTGGGACAGAACCC<br>CAGAATCCACTGTCCTGCAAGCGAAGAGCCCAGCACA<br>GAGAGCTGGATGGCCCAGTGGCACAGCGAAGCCATCA<br>GCTCTCCAGAAATACCCAAGGGAGTCACTGTTATTGCA<br>AGCACCAACCCAGAGCTGAGAAGACCTCGTTCTGAAC<br>CCTCTAATTACTACAGCAGTGAGAGCCACAAAGATTAT<br>CCGGCTCCCAAAAAGCATAAATTGAACCCTGAGTACTT<br>CCAGACAAGGCAGGAGAAGCTGCTTCCCACTGCACTG<br>AGTCTGGAAGAGCCAAATATCAGGAAGCAAAGCCCTA<br>GTTCTAAGCAGTCTGTCCCCGAGACACTCAGCCCCAGT<br>GAAGGAGTGAGGGACTTCAGCCGGGAACTCTCCCCTC<br>CCACTCCAGAGACTGCAGCATTTCAAGCCTCTGGATCT<br>CAGCCTGTAGGAAAGTGGAATTCCAAAGATCTTTACAT<br>TGGTGTGTCTACAGTACAGGTGACTGGAAATCCGAAG |

FIG. 27 Cont.

| sample | Gene Break point 5p | Gene Break point 3p | Frame Type | SEQ ID NO: | Fused Sequence |
|---|---|---|---|---|---|
| | | | | | GGGACCAGTGTAGGAAAGGAGGCAGCACCTTCACAG GTGCGTCCACGGGAACCAATGAGTGTCCTGATGATGG CTAACAGAGAGGTGGTGAATACAGAGCTGGGGTCCTA CCGTGATAGTGCAGAAAATGAAGAATGCGGCCAGCCC ATGGATGACATACAGGTGAACATGATGACCTTGGCAG AACACATTATTGAAGCCACACCTGACCGAATCAAGCAG GAGAATTTTGTGCCCATGGAGTCCTCAGGATTGGAAA GAACAGACCCTGCCACCATTAGCAGTACAATGAGCTG GCTGGCCAGTTATCTAGCGGATGCTGACTGCCTTCCCA GTGCTGCCCAGATCCGAAGTGCATATAACGAGCCTCTA ACCCCTTCTTCTAATACCAGCTTGAGCCCTGTTGGCTCT CCCGTCAGTGAAATCGCTTTCGAGAAACCTAACCTTCC CTCCGCCGCGGATTGGTCAGAATTCCTGAGTGCATCTA CCAGTGAGAAGGTAGAGAATGAGTTTGCTCAGCTCAC TCTGTCTGATCATGAACAGAGAGAACTCTATGAGGCTG CCAGGCTTGTCCAGACAGCTTTCCGGAAATACAAGGG CCGACCCTTGCGGGAACAGCAAGAAGTAGCTGCTGCT GTTATTCAGCGTTGTTACAGAAAATATAAACAGTACGC ACTTTATAAAAAGATGACACAGGCTGCCATCCTTATCC AGAGCAAATTCCGAAGTTACTATGAACAAAAAAAATTC CAGCAGAGCCGACGGGCTGCTGTGCTCATCCAAAAGT ACTACCGAAGTTATAAGAAATGTGGCAAAAGACGGCA GGCTCGCCGGACGGCTGTGATTGTACAACAGAAACTC AGGAGCAGTTTGCTAACCAAAAAGCAGGATCAAGCTG CTCGAAAAATAATGAGGTTTCTTCGCCGCTGTCGCCAC AGCCCCCTGGTGGACCATAGGCTGTACAAAAGGAGTG AAAGAATTGAAAAAGGCCAAGGAACT |
| GBM-CUMC3297_L1 | 24640521 | 18659539 | InFrame | 8359 | ATGGCCCGGGGCTACGGGGCCACGGTCAGCCTAGTCC TGCTGGGTCTGGGGCTGGCGCTGGCTGTCATTGTGCT GGCTGTGGTCCTCTCTCGACACCAGGCCCCATGTGGCC CCCAGGCCTTTGCCCACGCTGCTGTTGCCGCCGACTCC AAGGTCTGCTCGGATATTGGACG\|GCAGGAAACTGCA TATCTTCTGGTTTACATGAAGATGGAGTGC |
| GBM-CUMC3342_L1 | 61083748 | 104375025 | InFrame | 8360 | ATGTTTGTGTATGTGCTCACTCCCGGAGAGCAATCAGG GAGACGGCTCCCCGGCCAGACTTGGCTGATGTTTTCTT GTTTCTGTTTCAGCCTTCAGGATAATTCCTTCAGCAGCA CCACTGTAACAGAGTGTGACGAAGATCCAGTCTCTCTA CATGAAGACCAGACTGATTGCTCCAGTCTCAGAGATG AAAACAATAAAGAGAACTACCCCGACGCAGGGGCTCT GGTAGAAGAGCACGCGCCGCCCTCTTGGGAGCCGCAG CAGCAGAATGTAGAGGCGACCGTGCTGGTGGACAGC GTATTGCGACCCAGCATGGGCAACTTCAAGTCCAGGA AGCCCAAGTCCATCTTCAAAGCGGAGAGCGGGAGGA GCCACGGAGAAAGTCAGGAGACAGAGCATGTGGTAT CCAGCCAGTCAGAGTGTCAGGTGAGAGCAGGAACACC AGCTCATGAGAGTCCACAAAACAATGCCTTCAAGTGCC AAGAAACAGTGCGACTTCAACCAAG\|GAGCCGCAAAG ACAGCCTGGAAAGTGACAGCTCCACGGCCATCATTCCC CATGAGCTGATTCGCACGCGGCAGCTTGAGAGCGTAC ATCTGAAATTCAACCAGGAGTCCGGAGCCCTCATTCCT CTCTGCCTAAGGGGCAGGCTCCTGCATGGACGGCACT TTACATATAAAAGTATCACAGGTGACATGGCCATCACG TTTGTCTCCACGGGAGTGGAAGGCGCCTTTGCCACTGA GGAGCATCCTTACGCGGCTCATGGACCCTGGTTACAAA TTCTGTTGACCGAAGAGTTTGTAGAGAAAATGTTGGA |

FIG. 27 Cont.

| sample | Gene Break-point 5p | Gene Break-point 3p | Frame Type | SEQ ID NO: | Fused Sequence |
|---|---|---|---|---|---|
| | | | | | GGATTTAGAAGATTTGACTTCTCCAGAGGAATTCAAAC TTCCCAAAGAGTACAGCTGGCCTGAAAAGAAGCTGAA GGTCTCCATCCTGCCTGACGTGGTGTTCGACAGTCCGC TACAC |
| G17500. TCGA-27-1831-01A-01R-1850-01.2 | 39438743 | 41808143 | InFrame | 8361 | ATGCACTCAGCCGGGACTCCCGGGTTATCCTCGCGCCG GACAGGCAACTCCACCAGCTTTCAACCAGGACCGCCAC CGCCGCCCCGgctgctgctgctgctgctgctTCTCCTGTCACTG GTAAGCCGCGTCCCGGCACAGCCCGCTGCCTTCGGCA GGGCGTTGCTGTCCCTGGTCTCGCGGGGGCTGCAGG GGTCCCTGCTGAGGAGGCCATAGTGCTGGCGAACCGC GGACTCCGGGTGCCTTTCGGCCGTGAAGTCTGGCTGG ATCCCCTGCATGACCTGGTGTTGCAGGTGCAGCCCGG GGACCGCTGCGCGGTTTCGGTACTAGACAACGACGCA CTGGCCCAGCGACCGGGCCGCCTGAGTCCCAAGCGCT TCCCGTGCGACTTTGGCCCTGGCGAGGTGCGCTACTCT CACCTGGGCGCGCGCAGCCCGTCTCGGGACCGCGTCC GGCTGCAGCTGCGCTATGACGCGCCCGGAGGGGCAGT AGTGCTACCACTGGTACTGGAGGTGGAGGTGGTCTTC ACCCAGCTGGAGGTTGTGACTCGGAACTTGCCTCTGGT CGTGGAAGAGCTGCTGGGGACCAGCAATGCCCTGGAC GCGCGGAGCCTGGAGTTCGCCTTCCAGCCCGAGACAG AGGAGTGCCGCGTGGGCATCCTGTCCGGCTTGGGCGC GCTGCCTCGCTATGGAGAACTCCTCCACTACCCGCAGG TCCCTGGAGGAGCCAGAGAGGGAGGCGCCCCGGAGA CTCTCCTGATGGACTGCAAAGCTTTCCAGGAACTAGGC GTGCGCTATCGCCACACAGCCGCCAGTCGCTCACCAAA CAGGGACTGGATACCCATGGTGGTGGAGCTGCGTTCA CGAGGGGCTCCTGTGGGCAGCCCTGCTTTGAAACGCG AGCACTTCCAGGTTCTGGTGAGGATCCGAGGAGGGGC CGAGAACACTGCACCCAAGCCCAGTTTCGTGGCCATG ATGATGATGGAGGTGGACCAGTTTGTACTGACGGCCC TGACCCCAGACATGCTGGCAGCCGAGGATGCTGAGTC TCCCTCTGACCTGTTGATCTTCAACCTTACTTCTCCATTC CAGCCTGGCCAGGGCTACTTGGTGAGCACCGATGATC GCAGCCTGCCCCTTTCCTCCTTCACTCAGAGGGATCTG CGGCTCCTGAAGATTGCCTACCAGCCCCCTTCTGAAGA CTCTGACCAGGAGCGCCTCTTTGAACTGGAATTGGAG GTAGTGGATCTAGAAGGAGCAGCTTCAGACCCTTTTGC CTTCATGGTAGTGGTGAAGCCCATGAACACAATGGCTC CGGTGGTCACCCGGAATACCGGTCTTATTCTCTATGAG GGTCAGTCTCGGCCCCTCACAGGCCCTGCAGGCAGTG GTCCGCAAAACTTGGTCATCAGCGATGAGGATGACCT AGAAGCAGTGCGGCTAGAGGTGGTGGCTGGGCTCCG GCATGGTCACCTTGTCATTCTGGGTGCTTCCAGTGGCA GCTCTGCTCCCAAGAGCTTTACAGTGGCTGAGCTGGCA GCCGGCCAGGTGGTCTACCAGCATGATGACAGAGACG GCTCGCTGAGCGACAACCTGGTGCTTCGCATGGTGGA TGGAGGAGGCAGGCACCAGGTACAGTTTCTGTTCCCC ATCACCTTAGTGCCTGTGGATGACCAGCCACCTGTTCT CAATGCCAACACGGGGCTGACACTGGCAGAGGGTGA AACAGTGCCCATCCTGCCCCTTTCCCTGAGTGCAACTG ACATGGATTCAGATGATTCTCTGCTGCTTTTTGTGCTG GAGTCACCCTTCTTAACTACGGGGCATCTGCTTCTCCG CCAAACTCACCCTCCCCATGAGAAGCAGGAACTTCTCA GAGGCCTTTGGAGGAAGGAGGGGGCATTTTATGAGC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GAACAGTGACAGAGTGGCAGCAGCAGGACATAACAG AGGGCAGGCTGTTCTATAGACACTCTGGGCCCCATAGT CCTGGGCCAGTCACAGACCAGTTCACATTTAGAGTCCA GGATAACCATGACCCTCCTAATCAGTCCGGGCTACAGC GGTTTGTGATTCGTATCCATCCTGTGGATCGCCTCCCTC CGGAGCTGGGCAGTGGCTGTCCCCTTCGTATGGTGGT ACAGGAATCCCAGCTCACACCACTGAGGAAGAAGTGG CTGCGCTACACTGACCTGGACACAGATGACCGAGAAC TACGTTACACAGTGACTCAGTCCCCCACAGACACAGAC GAAAATCACCTGCCAGCCCCACTGGGTACCTTGGTCTT GACTGACAACCCCTCAGTCGTGGTGACCCATTTTACCC AAGCCCAGATCAACCATCATAAAATTGCTTACAGACCC CCGGGTCAAGAACTGGGCGTGGCTACTCGAGTGGCCC AGTTCCAGTTCCAGGTGGAAGACCGAGCTGGGAATGT GGCTCCAGGTACCTTTACCCTTTACTTGCATCCCGTGGA CAACCAGCCACCTGAGATCCTCAACACCGGCTTCACTA TTCAGGAGAAGGGTCACCACATCCTGAGTGAGACAGA GTTGCACGTGAATGATGTAGACACTGATGTTGCCCATA TCTCTTTCACTCTCACTCAGGCACCCAAACATGGCCACA TGAGAGTGTCTGGACAGATCCTGCATGTAGGGGGTCT CTTCCACTTGGAGGACATAAAACAGGGCCGAGTTTCCT ATGCCCATAATGGGGACAAGTCCCTGACTGATAGCTG CTCCTTGGAAGTCAGTGACAGACATCATGTGGTGCCCA TCACTCTCAGAGTAAATGTCCGGCCAGTGGATGATGA AGTGCCCATACTGAGCCATCCTACTGGCACTCTGGAGT CCTATCTAGATGTCTTAGAAAATGGGGCTACTGAAATC ACTGCCAATGTTATTAAGGGGACCAATGAGGAAACTG ATGACTTGATGTTGACTTTCCTCTTGGAAGATCCACCTT TGTATGGGGAAATCTTGGTCAATGGCATTCCAGCAGA GCAGTTTACTCAAAGGGACATCTTGGAGGGCTCTGTTG TATATACCCACACCAGTGGTGAGATAGGCCTATTGCCT AAAGCGGATTCTTTTAACCTGAGTCTGTCAGATATGTC TCAAGAATGGAGAATTGGTGGCAATACTATCCAAGGA GTTACTATATGGGTGACCATCCTGCCTGTTGATAGCCA GGCCCCAGAAATCTTTGTAGGTGAACAGTTGATAGTA ATGGAAGGTGATAAAAGTGTTATAACATCAGTGCATA TAAGTGCTGAAGATGTCGACTCCCTGAATGATGACATC TTGTGCACTATAGTTATTCAGCCTACTTCAGGTTATGTT GAAAACATTTCTCCAGCACCAGGCTCTGAGAAATCAAG AGCAGGGATTGCCATAAGTGCTTTCAACTTGAAAGATC TCAGGCAGGGCCACATAAACTATGTCCAGAGTGTCCAT AAAGGGGTGGAACCTGTGGAGGACCGATTTGTATTTC GTTGTTCTGATGGCATTAACTTTTCAGAGAGACAGTTC TTCCCCATTGTAATCATTCCCACCAATGATGAACAGCCA GAGATGTTTATGAGAGAATTTATGGTGATGGAAGGCA TGAGTCTGGTAATTGATACACCCATTCTCAATGCTGCT GATGCTGATGTTCCCCTGGATGATTTAACTTTCACTATT ACCCAATTCCCCACTCATGGTCACATCATGAATCAGCT GATAAATGGCACGGTTTTGGTCGAAAGCTTCACCTTGG ATCAGATCATAGAGAGTTCCAGCATTATTTATGAGCAT GATGACTCCGAGACCCAGGAAGCAGTTTTGTGATTA AACTAACAGATGGGAAGCACTCTGTGGAAAAGACGGT CCTCATTATAGTTATCCCTGTTGATGATGAGACGCCCA GAATGACTATCAATAATGGACTAGAAATAGAAATTGG GGATACCAAGATTATCAACAACAAAATATTAATGGCAA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CAGATTTAGATTCAGAAGACAAATCTTTGGTTTATATT ATTCGTTATGGGCCAGGACATGGCTTATTACAGAGAC GAAAACCTACTGGTGCCTTTGAAAATATCACACTGGGC ATGAATTTTACCCAGGATGAAGTAGACAGAAACTTAAT TCAGTATGTCCATTTGGGGCAAGAGGGCATTCGGGAC CTAATTAAATTTGATGTGACTGATGGAATAAATCCCCT CATAGATCGTTACTTTTATGTGTCCATCGGGAGCATTG ACATTGTCTTCCCTGATGTGATAAGTAAGGGAGTGTCC TTGAAAGAAGGTGGCAAAGTCACTCTTACAACAGACC TACTAAGCACTAGTGACTTGAACAGTCCTGATGAAAAC TTGGTTTTTACCATCACCAGGGCTCCCATGCGAGGTCA CCTGGAATGCACGGATCAGCCTGGTGTGTCCATCACGT CTTTCACTCAGCTGCAACTGGCTGGAAACAAAATCTAC TACATCCACACAGCTGATGATGAAGTGAAAATGGACA GTTTTGAGTTTCAAGTCACCGATGGACGTAACCCTGTC TTTCGGACATTCCGTATCTCCATTAGCGATGTGGACAA TAAAAAGCCAGTGGTCACCATCCACAAGCTGGTTGTCA GTGAAAGTGAAAACAAGCTGATTACTCCTTTTGAGCTC ACTGTCGAAGACAGAGATACTCCTGACAAGCTCCTGA AATTCACTATCACCCAGGTGCCTATTCATGGCCATCTCC TATTCAACAATACCAGACCTGTCATGGTTTTTACCAAGC AAGACTTGAATGAAAACTTAATCAGCTACAAACATGAT GGCACTGAGTCAAGTGAAGATAGCTTCTCCTTCACAGT GACTGATGGCACCCATACAGACTTCTATGTTTTTCCTGA TACGGTGTTTGAAACAAGGAGACCCCAAGTGATGAAG ATCCAGGTCTTGGCTGTTGACAACAGTGTCCCCCAAAT CGCAGTGAATAAGGGGGCCTCTACACTTCGCACTCTAG CCACTGGCCACTTGGGGTTCATGATCACAAGCAAAATA TTGAAAGTGGAGGACAGAGACAGCTTACACATTTCTCT TAGATTTATCGTGACAGAGGCCCCTCAACATGGATATC TTCTCAACCTGGACAAAGGCAACCACAGCATCACTCAG TTCACACAAGCTGACATTGATGACATGAAAATATGCTA TGTCTTAAGAGAAGGGGCTAATGCCACAAGTGATATG TTCTATTTTGCAGTTGAAGATGGTGGTGGAAACAAGTT AACGTACCAGAATTTTCGTCTGAATTGGGCATGGATCT CCTTTGAAAAGGAATATTACCTGGTCAATGAGGACTCC AAATTTCTAGATGTTGTTCTTAAACGTAGAGGTTACTT GGGAGAAACTTCTTTTATAAGTATTGGCACAAGAGAC AGAACTGCAGAAAAAGACAAAGACTTCAAGGGCAAA GCACAGAAACAAGTGCAGTTCAACCCAGGCCAGACCA GGGCCACATGGCGAGTGCGGATCCTGAGTGATGGGG AGCATGAGCAGTCTGAAACCTTTCAGGTGGTACTCTCA GAGCCCGTGCTGGCTGCCTTGGAATTCCCCACAGTCGC CACTGTTGAGATCGTTGATCCAGGAGATGAGCCAACT GTGTTTATTCCCCAGTCCAAATACTCCGTTGAAGAAGA TGTTGGTGAGCTGTTCATTCCCATCAGGAGGAGCGGA GATGTGAGCCAGGAGTTGATGGTGGTCTGTTATACCC AACAAGGAACAGCAACTGGAACTGTGCCGACTTCCGT GTTGTCTTACTCTGATTACATATCCAGGCCTGAGGACC ACACCAGTGTTGTCCGCTTTGACAAAGATGAACGGGA GAAACTGTGTCGGATAGTCATAATTGATGACTCTTTGT ACGAGGAGGAGGAAACCTTCCATGTCCTTCTGAGCAT GCCCATGGGGGAAGAATCGGATCAGAGTTCCCAGG GGCTCAAGTTACAATCGTTCCTGACAAAGATGATGAAC CCATCTTTTACTTCGGTGATGTGGAATACTCTGTGGAT |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GAGAGTGCTGGCTATGTGGAAGTGCAGGTGTGGAGA ACGGGCACTGACCTGTCCAAGTCTTCTAGTGTCACAGT GAGGTCTCGGAAAACAGATCCTCCCTCTGCAGATGCTG GAACAGACTATGTGGGCATCAGCCGTAATTTAGATTTT GCACCTGGAGTCAACATGCAGCCTGTTCGTGTTGTCAT TCTGGATGACCTTGGACAACCAGCGCTGGAGGGAATT GAGAAATTTGAACTGGTGCTTCGCATGCCTATGAACGC AGCCCTTGGCGAGCCCAGCAAAGCCACAGTGTCCATA AATGACTCTGTCTCCGATTTGCCTAAGATGCAATTCAA AGAACGAATATATACTGGCAGCGAAAGTGATGGGCAG ATAGTTACAATGATCCATAGGACTGGGGATGTCCAGT ACAGATCTTCAGTGAGATGCTACACCCGGCAGGGGTC TGCACAGGTGATGATGGACTTTGAAGAACGCCCAAAC ACTGATACCTCCATCATCACATTCCTCCCTGGTGAGACA GAAAAGCCCTGCATTCTTGAGCTGATGGACGATGTGCT CTATGAGGAGGTAGAGGAGCTCCGCCTGGTACTCGGC ACTCCACAAAGCAACTCTCCCTTTGGGGCTGCAGTTGG TGAACAAAATGAAACTCTCATAAGGATCCGAGATGAT GCTGATAAGACTGTTATTAAATTTGGAGAAACCAAATT TAGTGTCACTGAACCCAAAGAACCTGGAGAGTCGGTG GTTATAAGAATTCCAGTGATTCGCCAAGGAGACACTTC AAAGGTTTCCATTGTGAGAGTCCACACCAAGGATGGC TCGGCCACCTCTGGAGAAGACTACCACCCTGTGTCAGA AGAAATTGAGTTTAAGGAAGGGGAAACCCAGCACGTG GTTGAAATCGAAGTTACCTTTGACGGGGTGAGAGAGA TGAGAGAGGCCTTCACTGTTCACCTAAAACCTGATGAA AATATGATAGCAGAGATGCAGTTGACGAAAGCCATTG TGTACATAGAAGAAATGAGCAGCATGGCAGATGTCAC TTTTCCTTCTGTCCCTCAAATTGTATCCCTGTTGATGTAT GACGACACTTCCAAAGCTAAGGAGAGTGCTGAACCCA TGTCTGGCTATCCTGTCATCTGTATCACAGCTTGCAACC CCAAATATTCAGACTACGATAAAACAGGCTCTATCTGT GCAAGTGAGAACATCAATGACACTTTGACGCGGTACC GGTGGCTGATTAGTGCACCTGCGGGCCCTGACGGTGT GACCAGCCCTATGAGAGAAGTGGACTTCGACACCTTTT TTACGTCATCCAAGATGGTCACACTGGACTCCATATAC TTTCAGCCTGGCTCCCGGGTACAGTGCGCAGCTCGTGC TGTGAACACCAATGGGGATGAAGGCCTGGAGCTCATG AGCCCTATTGTAACCATCAGCAGAGAAGAAGGTCTTTG TCAGCCCCGTGTACCTGGGGTTGTTGGAGCAGAGCCG TTCTCAGCTAAATTGCGCTACACAGGCCCTGAGGATGC AGACTACACAAACCTTATCAAGCTCACTGTCACAATGC CACACATAGATGGCATGCTCCCCGTGATCTCCACTAGA GAGCTTTCCAACTTTGAGCTCACCCTCAGCCCTGATGG CACAAGAGTTGGAAACCACAAGTGCTCCAACCTCCTG GATTATACTGAAGTGAAGACTCATTATGGTTTCTTGAC TGATGCTACCAAAAATCCAGAAATAATTGGAGAGACA TATCCTTACCAGTACAGCTTGTCCATCAGAGGTTCCACT ACCTTGCGCTTCTACCGGAACCTGAACCTAGAGGCCTG TTTATGGGAGTTCGTTAGCTACTATGACATGTCAGAAC TCCTTGCTGACTGTGGTGGCACCATTGGAACAGATGG ACAG¦GTGGATGTGAAATTGGACCCCAAGGATTTGCG AATAGATACATTTCGAGCCAAAGGAGCAGGAGGGCA GCATGTTAATAAAACTGATAGTGCCGTCAGACTTGTCC ACATCCCCACAGGGCTAGTAGTAGAATGCCAACAAGA |

FIG. 27 Cont.

| sample | Gene Breakpoint 5p | Gene Breakpoint 3p | Frame Type | SEQ ID NO: | Fused Sequence |
|---|---|---|---|---|---|
| | | | | | AAGATCACAGATAAAAAATAAAGAAATAGCCTTTCGT GTGTTGAGAGCTAGACTCTACCAGCAGATTATTGAGA AAGACAAGCGTCAGCAACAAAGTGCTAGAAAACTGCA GGTGGGAACAAGAGCCCAGTCAGAGCGAATTCGGAC ATATAATTTCACCCAGGATAGAGTCAGTGACCACAGG ATAGCATATGAAGTTCGTGATATTAAGGCTCAGTCTCA TTCCACGGGTGGTAGTCGTGACCCTGCACATTCCACAT TCCTATCCTTGGATTCTGTGAGATCACCTGGTATTCTCA TTATGACTTCTTCTGTTAGGAATTTTTATGTGGTGGGA AGGGCCTGGATCAGC |
| G17212. TCGA-06-0129-01A-01R-1849-01.2 | 34104422 | 47221257 | InFrame | 8362 | ATGGCCATAGAccggcggcgcgaggcggcgggcggcgggcctgg gcggcagccggccccggccgaggagaacggctccctgccgcccgggg acgcggcggcctcggcgccctcgggggacgcgcgggcccggcggc ggcgcggAGATCCAGCCGCTGCCCCCACTGCATCCTGGA GGCGGCCCGCACCCGAGCTGCTGCTCCGCGGCTGCGG CCCCGAGCCTCTTGTTGCTGGACTATGACGGGTCGGTG CTGCCCTTCCTCGGGGGCCTGGGCGGGGGCTATCAGA AGACCCTCGTGCTGCTCACCTGGATCCCGGCGCTGTTC ATCGGCTTCAGCCAGTTCTCGGACTCGTTCCTCCTGGA CCAGCCCAACTTCTGGTGCCGCGGGGCCGGCAAAGGC ACCGAGCTGGCAGGGGTCACCACCACAGGCCGGGGC GGGGACATGGGCAACTGGACCAGCCTCCCCACCACCC CCTTCGCCACTGCCCCCTGGGAGGCTGCGGGCAACCG GAGCAACAGCAGCGGCGCGGACGGAGGCGACACACC ACCCCTGCCATCCCCTCCGGACAAGGGGGACAACGCC TCCAACTGTGACTGCCGCGCATGGGACTACGGCATCC GCGCCGGCCTCGTCCAGAACGTGGTCAGCAAGTGGGA TCTTGTGTGTGATAATGCCTGGAAGGTCCATATCGCTA AGTTCTCCTTACTGGTTGGATTAATCTTTGGCTACCTAA TAACTGGATGCATTGCTGACTGGGTCGGCCGGCGGCC TGTGCTGCTGTTTTCCATCATCTTCATTCTGATCTTTGG ACTGACTGTGGCACTGTCAGTGAATGTGACAATGTTCA GCACACTCAGGTTCTTTGAAGGATTTTGCCTGGCTGGA ATCATTCTCACCTTGTATGCTTTAC]GTATCGATATCCT GAAGCTTGTAGCAGCCCAAGTGGGAAGCCAGTGGAA AGATATCTATCAGTTTCTTTGCAATGCCAGTGAGAGGG AGGTTGCTGCTTTCTCCAATGGGTACACAGCCGACCAC GAGCGGGCCTACGCAGCTCTGCAGCACTGGACCATCC GGGGCCCCGAGGCCAGCCTCGCCCAGCTAATTAGCGC CCTGCGCCAGCACCGGAGAAACGATGTTGTGGAGAAG ATTCGTGGGCTGATGGAAGACACCACCCAGCTGGAAA CTGACAAACTAGCTCTCCCGATGagcccccagcccgcttagcc cgagcccccatccccagccccaacGCGAAACTTGAGAATTCCG CTCTCCTGACGGTGGAGCCTTCCCCACAGGACAAGAAC AAGGGCTTCTTCGTGGATGAGTCGGAGCCCCTTCTCCG CTGTGACTCTACATCCAGCGGCTCCTCCGCGCTGAGCA GGAACGGTTCCTTTATTACCAAAGAAAAGAAGGACAC AGTGTTGCGGCAGGTACGCCTGGACCCCTGTGACTTG CAGCCTATCTTTGATGACATGCTCCACTTTCTAAATCCT GAGGAGCTGCGGGTGATTGAAGAGATTCCCCAGGCTG AGGACAAACTAGACCGGCTATTCGAAATTATTGGAGT CAAGAGCCAGGAAGCCAGCCAGACCCTCCTGGACTCT GTTTATAGCCATCTTCCTGACCTGCTG |

FIG. 27 Cont.

| sample | Gene Breakpoint 5p | Gene Breakpoint 3p | Frame Type | SEQ ID NO: | Fused Sequence |
|---|---|---|---|---|---|
| GBM-CUMC33 22_L1 | 141255367 | 158715068 | InFrame | 8363 | ATGGAAAACACTG\|ATCGAAAAGTATCCTCCTTGCACA CCTCCCGAGTTCAGAGGCAGATGGTGGTCTCCGTTCAC GACTTACCCGAGAAGAGCTTTGTGCCCCTGCTGGACA GCAAATACGTCCTCTGTGTGTGGGATATTTGGCAGCCT TCAGGGCCACAGAAAGTTCTGATATGTGAGTCCCAGG TCACGTGTTGCTGCTTGAGCCCTTTGAAAGCATTTTTAC TGTTTGCCGGAACAGCGCACGGCTCAGTTGTCGTCTGG GATTTGAGAGAAGACTCAAGGCTGCATTACTCTGTGAC GCTGAGCGATGGCTTCTGGACGTTCCGGACCGCCACG TTTTCCACCGATGGAATCCTTACCTCAGTAAACCACCG AAGCCCTCTTCAAGCAGTAGAACCTATCTCAACGTCCG TCCACAAAAAGCAGAGCTTTGTGCTTTCACCCTTTTCTA CTCAAGAAGAAATGTCAGGTTTGTCCTTCCACATCGCT TCCTTGGATGAGAGTGGGGTTCTCAATGTATGGGTGG TTGTTGAATTACCAAAGGCAGACATCGCAGGTTCAATA AGTGATTTAGGTCTGATGCCTGGAGGGAGGGTCAAGC TGGTACATAGTGCTCTGATCCAGTTGGGTGACAGTCTT TCCCATAAAGGTAATGAATTTTGGGGCACTACACAAAC ACTGAATGTTAAATTTCTGCCTTCAGATCCTAATCACTT TATTATTGGCACAGACATGGGTCTCATAAGCCATGGCA CAAGACAAGATTTGAGAGTGGCTCCCAAACTATTCAAA CCTCAGCAACATGGTATAAGACCAGTGAAAGTTAATGT CATTGATTTTTCACCATTTGGAGAACCAATATTTTTGGC CGGCTGTTCGGACGGAAGCATCAGGCTGCACCAGCTG AGCTCCGCGTTTCCGCTCCTGCAGTGGGACAGCAGCAC GGACAGCCATGCGGTCACCGGCCTGCAGTGGTCCCCA ACCAGGCCTGCCGTGTTCCTGGTGCAGGACGACACAT CCAACATCTACATCTGGGACCTCCTCCAGAGCGATCTG GGTCCTGTCGCCAAACAGCAGGTCTCCCCCAACAGGCT GGTGGCCATGGCTGCGGTGGGTGAGCCTGAGAAGGC TGGTGGCAGCTTCCTGGCCCTGGTGCTGGCCAGGGCG TCTGGCTCCATCGACATCCAGCACCTGAAGAGGCGGT GGGCGGCCCCGGAGGTGGACGAGTGCAACAGGCTGC GTCTGCTTTTGCAGGAAGCCCTGTGGCCAGAGGGAAA ACTGCACAAG |
| G17675. TCGA-19-2624-01A-01R-1850-01.2 | 54379794 | 56297264 | InFrame | 8364 | ATGACATGCCCTCGCAATGTAACTCCGAACTCGTACGC GGAGCCCTTGGCTGCGCCCGGCGGAGGAGAGCGCTAT AGCCGGAGCGCAGGCATGTATATGCAGTCTGGGAGTG ACTTCAATTGCGGGGTGATGAGGGGCTGCGGGCTCGC GCCCTCGCTCTCCAAGAGGGACGAGGGCAGCAGCCCC AGCCTCGCCCTCAACACCTATCCGTCCTACCTCTCGCAG CTGGACTCCTGGGGCGACCCCAAAGCCGCCTATCGCCT GGAACAACCTGTTGGCAGGCCGCTGTCCTCCTGCTCCT ACCCACCTAGTGTCAAGGAGGAGAATGTCTGCTGCAT GTACAGCGCAGAGAAGCGGGCGAAAAGTGGCCCCGA GGCAGCTCTCTACTCCCACCCCTTGCCGGAGTCCTGCC TTGGGGAGCACGAGGTACCCGTGCCCAGCTACTACCG CGCCAGCCCGAGCTACTCCGCGCTGGACAAGACGCCC CACTGTTCTGGGGCCAACGACTTCGAAGCCCCTTTCGA GCAGCGGGCCAGTCTCAACCCGCGCGCCGAACATCTG GAATCGCCTCAGCTGGGGGGCAAAGTGAGTTTCCCTG AGACCCCCAAGTCCGACAGCCAGACCCCCAGCCCCAAT GAAATCAAGACGGAGCAGAGCCTGGCGGGCCCTAAA GGGAGCCCCTCGGAGAGCGAAAAGGAGAGGGCCAAA GCTGCCGACTCAGCCCAGACACCTCGGATAACGAAG |

FIG. 27 Cont.

| sample | Gene Breakpoint 5p | Gene Breakpoint 3p | Frame Type | SEQ ID NO: | Fused Sequence |
|---|---|---|---|---|---|
| | | | | | CGAAAG\|GCAAGTATATCGCGTCAACACAGCGACCTG<br>ACGGGACCTGGCGCAAGCAGCGGAGGGTGAAAGAAG<br>GATATGTGCCCCAGGAGGAGGTCCCAGTATATGAAAA<br>CAAGTATGTGAAGTTTTTCAAGAGTAAACCAGAGTTGC<br>CCCCAGGGCTAAGCCCTGAGGCCACTGCTCCTGTCACC<br>CCATCCAGGCCTGAAGGTGGTGAACCAGGCCTCTCCA<br>AGACAGCCAAACGTAACCTGAAGCGAAAGGAGAAGA<br>GGCGGCAGCAGCAAGAGAAAGGAGAGGCAGAGGCCT<br>TGAGCAGGACTCTTGATAAGGTGTCCCTGGAAGAGAC<br>AGCCCAACTCCCCAGTGCTCCACAGGGCTCTCGGGCA<br>GCCCCCACAGCTGCATCTGACCAGCCTGACTCAGCTGC<br>CACCCACTGAGAAAGCCAAGAAGATAAAGAACCTAAAG<br>AAGAAACTCCGGCAGGTGGAAGAGCTGCAGCAGCGG<br>ATCCAGGCTGGGGAAGTCAGCCAGCCTAGCAAAGAGC<br>AGCTAGAAAAGCTAGCAAGGAGGAGGGCGCTAGAAG<br>AGGAGTTAGAGGACTTGGAGTTAGGCCTC |
| G17803.<br>TCGA-76-<br>4925-<br>01A-01R-<br>1850-<br>01.4 | 78046509 | 10694746 | InFrame | 8365 | ATGGCTGCTGAGAAGCAGGTCCCAggcggcggcggcggcg<br>gcggcagtggcggcggcggtggcagtggcggcggcggtagcggcggt<br>ggACGTGGTGCCGGAGGGGAAGAAAATAAAGAAAAC<br>GAACGCCCTTCGGCCGGATCGAAGGCAAACAAAGAAT<br>TTGGGGATAGCCTGAGTTTGGAGATTCTTCAGATTATT<br>AAGGAATCCCAGCAGCAGCATGGTTTACGGCATGGAG<br>ATTTTCAGAGGTACAGGGGCTACTGTTCCCGTAGACAA<br>AGACGTCTTCGAAAAACACTCAACTTCAAGATGGGTAA<br>CAGACACAAATTCACAGGGAAGAAAGTGACTGAAGAG<br>CTTCTGACCGATAATAGATACTTGCTTCTGGTTCTGATG<br>GATGCTGAAAGAGCCTGGAGCTACGCCATGCAGCTGA<br>AACAGGAAGCCAACACTGAACCCCGAAAACGGTTTCA<br>CTTGTTATCTCGCCTACGCAAAGCCGTGAAGCATGCAG<br>AGGAATTGGAACGCTTGTGTGAGAGCAATCGCGTGGA<br>TGCCAAGACCAAATTAGAGGCTCAGGCTTACACAGCTT<br>ACCTCTCAGGAATGCTACGTTTTGAACATCAAGAATGG<br>AAAGCTGCCATTGAGGCTTTTAACAAATGCAAAACTAT<br>CTATGAGAAGCTAGCCAGTGCTTTCACAGAGGAGCAG<br>GCTGTGCTGTATAACCAACGTGTGGAAGAGATTTCACC<br>CAACATCCGCTATTGTGCATATAATATTGGGGACCAGT<br>CAGCCATCAATGAACTCATGCAGATGAGATTGAGGTCT<br>GGGGGCACTGAGGGTCTCTTGGCTGAAAAATTGGAGG<br>CTTTGATCACTCAGACTCGAGCCAAACAGGCAGCTACC<br>ATGAGTGAAGTGGAGTGGAGAGGGAGAACGGTTCCA<br>GTGAAGATTGACAAAGTGCGCATTTTCTTATTAGGACT<br>GGCTGATAACGAAGCAGCTATTGTCCAGGCTGAAAGC<br>GAAGAAACTAAGGAGCGCCTGTTTGAATCAATGCTCA<br>GCGAGTGTCGGGACGCCATCCAGGTGGTTCGGGAGG<br>AGCTCAAGCCAGATCAG\|CCATTGATCAGCCGCAACTA<br>CAAGGGCGATGTGGCCATGAGCAAGATTGAGCACTTC<br>ATGCCTTTGCTGGTACAGCGGGAGGAGGAAGGCGCCC<br>TGGCCCCGCTGCTGAGCCACGGCCAGGTCCACTTCCTA<br>TGGATCAAACACAGCAACCTCTACTTGGTGGCCACCAC<br>ATCGAAGAATGCCAATGCCTCCCTGGTGTACTCCTTCC<br>TGTATAAGACAATAGAGGTATTCTGCGAATACTTCAAG<br>GAGCTGGAGGAGGAGAGCATCCGGGACAACTTTGTCA<br>TCGTCTACGAGTTGCTGGACGAGCTCATGGACTTTGGC<br>TTCCCGCAGACCACCGACAGCAAGATCCTGCAGGAGT<br>ACATCACTCAGCAGAGCAACAAGCTGGAGACGGGCAA |

FIG. 27 Cont.

| sample | Gene Break point 5p | Gene Break point 3p | Frame Type | SEQ ID NO: | Fused Sequence |
|---|---|---|---|---|---|
| | | | | | GTCACGGGTGCCACCCACTGTCACCAACGCTGTGTCCT GGCGCTCCGAGGGTATCAAGTATAAGAAGAACGAGGT CTTCATTGATGTCATAGAGTCTGTCAACCTGCTGGTCA ATGCCAACGGCAGCGTCCTTCTGAGCGAAATCGTCGG TACCATCAAGCTCAAGGTGTTTCTGTCAGGAATGCCAG AGCTGCGGCTGGGCCTCAATGACCGCGTGCTCTTCGA GCTCACTGGCCTTTCAGGCAGCAAGAACAAATCAGTA GAGCTGGAGGATGTAAAATTCCACCAGTGCGTGCGGC TCTCTCGCTTTGACAACGACCGCACCATCTCCTTCATCC CGCCTGATGGTGACTTTGAGCTCATGTCATACCGCCTC AGCACCCAGGTCAAGCCACTGATCTGGATTGAGTCTGT CATTGAGAAGTTCTCCCACAGCCGCGTGGAGATCATG GTCAAGGCCAAGGGGCAGTTTAAGAAACAGTCAGTGG CCAACGGTGTGGAGATATCTGTGCCTGTACCCAGCGAT GCCGACTCCCCCAGATTCAAGACCAGTGTGGGCAGCG CCAAGTATGTGCCGGAGAGAAACGTCGTGATTTGGAG TATTAAGTCTTTCCCGGGGGGCAAGGAGTACTTGATGC GAGCCCACTTTGGCCTCCCCAGTGTGGAAAAGGAAGA GGTGGAGGGCCGGCCCCCCATCGGGGTCAAGTTTGAG ATCCCCTACTTCACCGTCTCTGGGATCCAGGTCCGATA CATGAAGATCATTGAGAAAAGTGGTTACCAGGCCCTG CCCTGGGTTCGCTACATCACCCAGAGTGGCGATTACCA ACTTCGTACCAGC |
| G17796. TCGA-41- 5651- 01A-01R- 1850- 01.4 | 58186856 | 57849877 | InFrame | 8366 | ATGTCGCTGCTGCGGTCGCTGCGCGTGTTTCTGGTCGC GCGGACCGGGAGCTACCCGGCTGGGTCTCTTCTGCGT CAGTCGCCCCAGCCAAGGCACACATTTTATGCTGGGCC CCGTCTGTCTGCCTCGGCCTCCAGCAAGGAGCTCCTCA TGAAGCTGCGGCGGAAAACAGGCTACTCCTTTGTAAA TTGCAAGAAAGCTCTGGAGACTTGTGGCGGGGACCTC AAACAGGCAGAGATCTGGCTCCACAAGGAGGCCCAGA AGGAGGGCTGGAGCAAAGCTGCCAAGCTCCAAGGGA GGAAGACCAAAGAAGGCCTGATTGGGCTGTTGCAGG AAGGAAACACAACTGTATTAGTAGAGGTAAACTGTGA GACAGATTTTGTTTCTAGAAATTTAAAATTTCAACTGTT GGTCCAGCAAGTAGCCCTTGGAACCATGATGCATTGTC AGACCCTAAAGGATCAACCCTCTGCATACAGTAAAgtgc agtggctcacgcctgtaaacctagcactttgggaggctgaagcaggtgg atcacttgagGGTTTCTTGAATTCCTCTGAGCTTTCTGGAC TTCCAGCTGGGCCTGACAGAGAAGGCTCACTCAAGGA TCAGTTGGCTTTAGCAATTG\|ACTCCACTTCAGCCTACA GCTCCCTGCTCACTTTTCACCTGTCCACTCCTCGGTCCC ACCACCTGTACCATGCCCGCCTGTGGCTGCACGTGCTC CCCACCCTTCCTGGCACTCTTTGCTTGAGGATCTTCCGA TGGGGACCAAGGAGGAGGCGCCAAGGGTCCCGCACT CTCCTGGCTGAGCACCACATCACCAACCTGGGCTGGCA TACCTTAACTCTGCCCTCTAGTGGCTTGAGGGGTGAGA AGTCTGGTGTCCTGAAACTGCAACTAGACTGCAGACCC CTAGAAGGCAACAGCACAGTTACTGGACAACCGAGGC GGCTCTTGGACACAGCAGGACACCAGCAGCCCTTCCTA GAGCTTAAGATCCGAGCCAATGAGCCTGGAGCAGGCC GGGCCAGGAGGAGGACCCCCACCTGTGAGCCTGCGAC CCCCTTATGTTGCAGGCGAGACCATTACGTAGACTTCC AGGAACTGGGATGGCGGGACTGGATACTGCAGCCCG AGGGGTACCAGCTGAATTACTGCAGTGGGCAGTGCCC TCCCCACCTGGCTGGCAGCCCAGGCATTGCTGCCTCTT |

FIG. 27 Cont.

| sample | Gene Break-point 5p | Gene Break-point 3p | Frame Type | SEQ ID NO: | Fused Sequence |
|---|---|---|---|---|---|
| | | | | | TCCATTCTGCCGTCTTCAGCCTCCTCAAAGCCAACAATC CTTGGCCTGCCAGTACCTCCTGTTGTGTCCCTACTGCCC GAAGGCCCCTCTCTCTCCTCTACCTGGATCATAATGGC AATGTGGTCAAGACGGATGTGCCAGATATGGTGGTGG AGGCCTGTGGCTGCAGC |
| G17663. TCGA-19-2619-01A-01R-1850-01.2 | 70800719 | 94827661 | InFrame | 8367 | ATGGCTTCACTGAGAAGAGTCAAAGTGCTGTTGGTGTT GAACTTGATCGCGGTAGCCGGCTTCGTGCTCTTCCTGG CCAAGTGCCGGCCCATCGCGGTGCGCAGCGGAGACGC CTTCCACGAGATCCGGCCGCGCGCCGAGGTGGCCAAC CTCAGCGCGCACAGCGCCAGCCCCATCCAGGATGCGG TCCTGAAGCGCCTGTCGCTGCTGGAGGACATCGTGTAC CGGCAGCTGAATGGCTTATCCAAATCCCTTGGGCTCAT TGAAGGTTATGGTGGGCGGGTAAAGGGGGCCTTCC GGCTACTCTTTCCCCGGCTGAAGAAGAAAAGGCTAAG GGACCCCATGAGAAGTATGGCTACAATTCATACCTCAG TGAAAAAATTTCACTGGACCGTTCCATTCCGGATTATC GTCCCACCAA\|ATTTGTTATTGGGCGGGAAAAACCAGG ACAAGTGAGCGAGGTTGCCCAGTTGATAAGCCAGACA CTGGAACAGGAGAGGCGCCAGAGAGAGCTGCTGGAA CAGCACTATGCCCAGTATGATGCCGACGATGACGAGA ACACTGTGGCTGAATTGCAAGGAATGTCTGGCAACTG CAATAACAATAACAACTATTTTCTTAAGACAGGAGAAT ATGCCACAGATGAAGAAGAAGATGAGGTAGGACCTGT CCTTCCTGGCAGCGACATGGCCATTGAAGTCTTTGAGC TGCCTGAGAATGAGGACATGTTTTCCCCATCAGAACTG GACACAAGCAAGCTCAGTCACAAGTTCAAAGAGTTGC AAATCAAACATGCAGTTACAGAAGCAGAGATTCAAAA ATTGAAGACCAAGCTGCAGGCAGCAGAAAATGAGAAA GTGAGGTGGGAACTAGAAAAAACCCAACTCCAACAAA ACATAGAAGAGAATAAGGAAAGAATGTTGAAGTTGGA AAGCTACTGGATTGAGGCCCAAACATTATGCCACACA GTGAATGAGCATCTCAAAGAGACTCAAAGCCAGTATC AGGCCTTGGAAAAGAAATACAACAAGGCAAAGAAGTT GATCAAGGATTTTCAACAAAAAGAGCTTGATTTCATCA AAAGACAGGAAGCAGAAAGAAAGAAAATAGAAGATT TGGAAAAAGCTCATCTTGTGGAAGTGCAAGGCCTCCA AGTGCGGATTAGAGATTTGGAAGCTGAGGTATTCAGG CTACTGAAGCAAAATGGGACTCAAGTTAACAATAATAA CAACATCTTTGAGAGAAGAACATCTCTTGGTGAAGTCT CTAAAGGGGATACCATGGAGAACTTGGATGGCAAGCA GACATCTTGCCAAGATGGCCTAAGTCAAGACTTGAATG AAGCAGTCCCAGAGACAGAGCGCCTGGATTCAAAAGC ACTGAAAACTCGAGCCCAGCTCTCTGTGAAGAACAGA CGCCAGAGACCCTCTAGGACAAGACTGTATGATAGTG TTAGTTCCACAGATGGGGAGGACAGTCTAGAGAGAAA GCCATCAAACAGTTTCTATAACCACATGCATATTACCA AATTACTTCCACCTAAGGGTTTGAGAACGTCTTCTCCA GAATCAGATTCTGGTGTTCCACCCCTCACCCCGGTGGA TAGCAATGTGCCCTTCTCGTCTGACCACATAGCTGAAT TTCAAGAAGAACCACTGGACCCAGAAATGGGGCCTCT CTCCTCTATGTGGGGAGACACTTCACTGTTTTCTACTTC AAAGTCTGATCATGATGTGGAAGAATCTCCTTGCCATC ACCAAACCACCAACAAGAAAATATTACGAGAAAAAGA TGATGCCAAAGATCCCAAATCACTAAGGGCATCCAGTT CATTGGCGGTGCAAGGAGGAAAAATTAAGCGGAAGTT |

| sample | Gene Breakpoint 5p | Gene Breakpoint 3p | Frame Type | SEQ ID NO: | Fused Sequence |
|---|---|---|---|---|---|
| | | | | | TGTGGATCTGGGGGCGCCTTTGCGAAGGAATTCCAGC AAGGGAAAGAAGTGGAAAGAAAAAGAAAAAGAAGCC AGTAGGTTTTCTGCAGGTAGCAGGATCTTCAGAGGCA GACTGGAAAACTGGACACCCAAGCCATGTTCAACAGC TCAGACCTCCACTCGTTCCCCTTGCATGCCTTTCTCATG GTTTAATGACAGCCGGAAAGGATCCTATTCCTTCAGGA ACCTGCCTGCGCCTACAAGTTCCCTTCAGCCTTCTCCTG AGACTCTAATTTCAGATAAAAAGGGGTCCAAGGTAGA AAACACATGGATTACAAAAGCAAACAAGAGAAACCCA AATCCCTCCTCTTCTTCAATCTTTGGAAGGCATTCTCAA CTTATGTCTGTAGTCTGGATCCAAGAAACCAATAATTTT ACCTTCAATGATGACTTCAGTCCCAGCAGTACCAGTTC AGCAGACCTCAGCGGCTTAGGAGCAGAACCTAAAACA CCAGGGCTCTCTCAGTCCTTAGCACTGTCATCAGATGA GATCCTTGATGATGGACAGTCTCCCAAACACAGTCAGT GTCAGAATCGGGCCGTTCAGGAATGGAGTGTGCAGCA GGTTTCTCACTGGTTAATGAGCCTAAATCTGGAGCAGT ATGTATCTGAATTCAGTGCCCAAAACATCACTGGAGAA CAGCTCCTGCAGTTGGATGGAAATAAACTTAAGGCTCT TGGAATGACAGCATCCCAGGACCGAGCAGTGGTCAAA AAGAAACTCAAGGAAATGAAGATGTCTCTAGAGAAGG CTCGGAAGGCCCAAGAGAAATGGAAAAACAAAGAG AAAAGCTAAGGAGAAAGGAGCAAGAGCAAATGCAGA GGAAGTCCAAAAAGACAGAAAAGATGACGTCAACTAC AGCCGAGGGTGCTGGTGAGCAG |
| G17207. TCGA-06-0156-01A-03R-1849-01.2 | 910775 | 4438632 | InFrame | 8368 | ATGCAG\|AGACACGCAGGCCCATGAGAACAGCAGGGAT AGCCGGCTGGCATGGATGGGCACCTGGGAGCACCTTG TGTCTACTGGATTCAACCAGATGCGTGAGCGCGAAGT GAAGCTGTGGGACACGCGGTTCTTCTCCAGCGCCCTG GCCTCCCTCACCTTGGACACCTCGCTTGGGTGTCTCGT GCCTCTGCTGGACCCTGACTCTGGGCTCCTGGTCCTGG CAGGAAAGGGCGAGAGGCAGCTGTACTGTTACGAGG TGGTCCCGCAGCAGCCGGCGCTGAGCCCAGTGACCCA GTGTGTCCTGGAGAGCGTGCTGCGTGGGGCTGCCCTT GTGCCCGGCAGGCGCTGGCCGTCATGAGCTGCGAGG TACTCCGCGTCCTACAGCTGAGCGACACAGCCATCGTG CCCATCGGCTACCATGTGCCCCGCAAGGCTGTGGAGTT CCACGAGGACCTGTTCCCGGACACTGCCGGCTGTGTG CCTGCCACCGACCCCCATAGCTGGTGGGCTGGGGACA ACCAGCAGGTGCAGAAGGTCAGCCTCAACCCCGCCTG CCGGCCCCACCCCGAGCTTCACTTCCTGTCTGGTGCCCC CTGCGGAGCCCCTCCCTGACACAGCCCAGCCTGCGGT GATGGAGACACCCGTGGGTGATGCAGACGCAAGCGA GGGTTTCTCTTCCCCTCCCAGTTCGCTGACCTCGCCCTC CACGCCCTCCAGCCTGGGGCCCTCACTCTCCAGCACCA GTGGCATCGGGACCAGCCCCAGTTTGAGGTCGCTGCA GAGCCTGCTGGGCCCCAGTTCCAAGTTCCGCCATGCTC AGGGCACTGTCCTGCACCGAGACAGCCACATCACCAA CCTCAAGGGGCTCAACCTCACCACACCTGGTGAGAGT GACGGCTTCTGTGCCAACAAGCTGCGTGTGGCCGTGC CGCTGCTCAGCAGCGGGGGACAGGTGGCTGTGCTTGA GCTACGGAAGCCTGGCCGCCTGCCCGACACGGCACTG CCCACGCTGCAGAATGGGGCAGCTGTGACTGATCTGG CCTGGGACCCCTTTGACCCCCATCGCCTCGCTGTGGCT GGTGAGGACGCCAGGATCCGACTGTGGCGGGTACCC |

FIG. 27 Cont.

| sample | Gene Breakpoint 5p | Gene Breakpoint 3p | Frame Type | SEQ ID NO: | Fused Sequence |
|---|---|---|---|---|---|
| | | | | | GCAGAGGGCCTGGAAGAGGTGCTCACCACGCCAGAG ACTGTGCTCACAGGCCACACGGAGAAGATCTGCTCCCT GCGCTTCCACCCACTGGCAGCCAATGTGCTGGCCTCGT CCTCCTATGACCTCACTGTTCGCATCTGGGACCTTCAG GCTGGAGCTGATCGGCTGAAGCTGCAGGGCCACCAAG ACCAGATCTTCAGCCTGGCCTGGAGTCCTGATGGGCA GCAGCTGGCCACTGTCTGCAAGGATGGGCGTGTGCGG GTCTACAGGCCCCGGAGTGGCCCTGAGCCCCTGCAGG AAGGCCCAGGGCCCAAGGGAGGACGCGGAGCTCGCA TTGTCTGGGTATGTGATGGTCGCTGTCTGCTGGTGTCT GGCTTTGACAGCCAAAGTGAGCGCCAGCTGCTCCTATA TGAAGCTGAGGCCCTGGCCGGCGGACCCTTGGCAGTG TTGGGCCTGGACGTGGCTCCCTCAACCCTGCTGCCCAG CTACGACCCAGACACTGGCCTGGTGCTCCTGACCGGCA AGGGCGACACCCGTGTATTCCTGTACGAGCTGCTCCCC GAGTCCCCTTTCTTCCTGGAGTGCAACAGCTTCACGTC GCCTGACCCCCACAAGGGCCTCGTCCTCCTGCCTAAGA CGGAGTGCGACGTGCGGGAAGTGGAGCTGATGCGGT GCCTGCGGCTGCGTCAGTCCTCCCTGGAGCCTGTGGCC TTCCGGCTGCCCCGAGTCCGGAAAGAGTTCTTCCAGGA TGACGTGTTCCCAGACACGGCTGTGATCTGGGAGCCT GTGCTCAGTGCCGAGGCCTGGCTGCAAGGCGCTAATG GGCAGCCCTGGCTTCTCAGCCTGCAGCCTCCTGACATG AGCCCAGTGAGCCAAGCCCCCGAGAGGCCCCTGCTC GTCGGGCCCCATCCTCAGCGCAGTACCTGGAAGAAAA GTCTGACCAGCAAAAGAAGGAGGAGCTGCTGAATGCC ATGGTGGCAAAACTGGGGAACCGGGAGGACCCACTCC CCCAGGACTCCTTTGAAGGCGTGGACGAGGACGAGTG GGAC |
| G17802. TCGA-28-5208-01A-01R-1850-01.4 | 55433922 | 56079562 | InFrame | 8369 | ATGGGCGAGACCATGTCAAAGAGGCTGAAGCTCCACC TGGGAGGGGAGGCAGAAATGGAGGAACGGGCGTTCG TCAACCCCTTCCCGGACTACGAGGCCGCCGCCGGGGC GCTGCTCGCCTCCGGAGCGGCCGAAGAGACAGGCTGT GTTCGTCCCCCGGCGACCACGGATGAGCCCGGCCTCCC TTTTCATCAGGACGGGAAG|GATGCTTTCATTGGATTT GGAGGAAATGTGATCAGGCAACAAGTCAAGGATAAC GCCAAATGGTATATCACTGATTTTGTAGAGCTGCTGGG AGAACTGGAAGAA |
| G17485. TCGA-14-1402-02A-01R-2005-01.2 | 151216546 | 151372723 | InFrame | 8370 | ATGCCGCAGTCCAAGTCCCGGAAGATCGCGATCCTGG GCTACCGGTCTGTGG|CCTCCGGCCTCTCCTCCTCTCCG TCAACACCCACCCAAGTGACCAAGCAGCACACGTTTCC CCTGGAATCCTATAAGCACGAGCCTGAACGGTTAGAG AATCGCATCTATGCCTCGTCTTCCCCCCCGGACACAGG GCAGAGGTTCTGCCCGTCTTCCTTCCAGAGCCCGACCA GGCCTCCACTGGCATCACCGACACACTATGCTCCCTCC AAAGCCGCGGCGCTGGCGGCGGCCCTGGGACCCGCG GAAGCCGGCATGCTGGAGAAGCTGGAGTTCGAGGAC GAAGCAGTAGAAGACTCAGAAAGTGGTGTTTACATGC GATTCATGAGGTCACACAAGTGTTATGACATCGTTCCA ACCAGTTCAAAGCTTGTTGTCTTTGATACTACATTACAA GTTAAAAAGGCCTTCTTTGCTTTGGTAGCCAACGGTGT CCGAGCAGCGCCACTGTGGGAGAGTAAAAAACAAAGT TTTGTAGGAATGCTAACAATTACAGATTTCATAAATAT ACTACATAGATACTATAAATCACCTATGGTACAGATTT ATGAATTAGAGGAACATAAAATTGAAACATGGAGGGA |

FIG. 27 Cont.

| sample | Gene Break-point 5p | Gene Break-point 3p | Frame Type | SEQ ID NO: | Fused Sequence |
|---|---|---|---|---|---|
| | | | | | GCTTTATTTACAAGAAACATTTAAGCCTTTAGTGAATAT ATCTCCAGATGCAAGCCTCTTCGATGCTGTATACTCCTT GATCAAAAATAAAATCCACAGATTGCCCGTTATTGACC CTATCAGTGGGAATGCACTTTATATACTTACCCACAAA AGAATCCTCAAGTTCCTCCAGCTTTTTATGTCTGATATG CCAAAGCCTGCCTTCATGAAGCAGAACCTGGATGAGC TTGGAATAGGAACGTACCACAACATTGCCTTCATACAT CCAGACACTCCCATCATCAAAGCCTTGAACATATTTGT GGAAAGACGAATATCAGCTCTGCCTGTTGTGGATGAG TCAGGAAAAGTTGTAGATATTTATTCCAAATTTGATGT AATTAATCTTGCTGCTGAGAAAACATACAATAACCTAG ATATCACGGTGACCCAGGCCCTTCAGCACCGTTCACAG TATTTTGAAGGTGTTGTGAAGTGCAATAAGCTGGAAAT ACTGGAGACCATCGTGGACAGAATAGTAAGAGCTGAG GTCCATCGGCTGGTGGTGGTAAATGAAGCAGATAGTA TTGTGGGTATTATTTCCCTGTCGGACATTCTGCAAGCC CTGATCCTCACACCAGCAGGTGCCAAACAAAAGGAGA CAGAAACGGAG |
| NYU_E | 88033698 | 87883123 | InFrame | 8371 | ATGGGTGCTGGGCCCTCCTTGCTGCTCGCCGCCCTCCT GCTGCTTCTCTCCGGCGACGGCGCCGTGCGCTGCGAC ACACCTGCCAACTGCACCTATCTTGACCTGCTGGGCAC CTGGGTCTTCCAGGTGGGCTCCAGCGGTTCCCAGCGC GATGTCAACTGCTCGGTTATGGGACCACAAGAAAAAA AAGTAGTGGTGTACCTTCAGAAGCTGGATACAGCATA TGATGACCTTGGCAATTCTGGCCATTTCACCATCATTTA CAACCAAGGCTTTGAGATTGTGTTGAATGACTACAAGT GGTTTGCCTTTTTTAAGTATAAAGAAGAGGGCAGCAA GGTGACCACTTACTGCAACGAGACAATGACTGGGTGG GTGCATGATGTGTTGGGCCGGAACTGGGCTTGTTTCA CCGGAAAGAAGGTGGGAACTGCCTCTGAGAATGTGTA TGTCAACATAGCACACCTTAAGAATTCTCAGGAAAAGT ATTCTAATAGGCTCTACAAGTATGATCACAACTTTGTG AAAGCTATCAATGCCATTCAGAAGTCTTGGACTGCAAC TACATACATGGAATATGAGACTCTTACCCTGGGAGATA TGATTAGGAGAAGTGGTGGCCACAGTCGAAAAATCCC AAGGCCCAAACCTGCACCACTGACTGCTGAAATACAG CAAAAGATTTTGCATTTGCCAACATCTTGGGACTGGAG AAATGTTCATGGTATCAATTTTGTCAGTCCTGTTCGAAA CCAAG\|GTCAAGAAAGATTTGGAAACATGACGAGGGT CTATTACCGAGAAGCTATGGGTGCATTTATTGTCTTCG ATGTCACCAGGCCAGCCACATTTGAAGCAGTGGCAAA GTGGAAAATGATTTGGACTCCAAGTTAAGTCTCCCTA ATGGCAAACCGGTTTCAGTGGTTTTGTTGGCCAACAAA TGTGACCAGGGGAAGGATGTGCTCATGAACAATGGCC TCAAGATGGACCAGTTCTGCAAGGAGCACGGTTTCGT AGGATGGTTTGAAACATCAGCAAAGGAAAATATAAAC ATTGATGAAGCCTCCAGATGCCTGGTGAAACACATACT TGCAAATGAGTGTGACCTAATGGAGTCTATTGAGCCG GACGTCGTGAAGCCCCATCTCACATCAACCAAGGTTGC CAGCTGCTCTGGCTGTGCCAAATCC |
| G17212. TCGA-06-0129-01A-01R | 51128913 | 42019095 | InFrame | 8372 | ATGGCGGAACGAGGCCTGGAGCCGTCGCCGGCCGCG GTGGCGGCGCTGCCGCCTGAAGTGCGGGCGCAGCTG GCGGAGCTGGAGCTGGAGCTCTCGGAGGGGGACATC ACCCAGAAGGGCTATGAAAAGAAAAGGTCCAAACTCC TATCTCCTTACAGCCCGCAGACACAAGAAACTGATTCA |

FIG. 27 Cont.

| sample | Gene Breakpoint 5p | Gene Breakpoint 3p | Frame Type | SEQ ID NO: | Fused Sequence |
|---|---|---|---|---|---|
| 1849-01.2 | | | | | GCAGTACAGAAAGAACTTAGAAACCAGACACCTGCTC<br>CATCTGCAGCTCAAACTTCTGCTCCCTCTAAGTACCACC<br>GAACTCGATCTGGGGGAGCCAGGGATGAACGATATCG<br>ATCAGATATCCACACAGAAGCAGTTCAGGCTGCACTG<br>GCAAAGCATAAAGAACAGAAGATGGCTTTGCCCATGC<br>CAACCAAAAGGCGATCCACATTTGTTCAGTCTCCTGCA<br>GATGCCTGCACACCTCCTGACACATCTTCGGCCTCTGA<br>GGATGAGGGCTCTCTGAGACGCCAAGCTGCGCTCTCT<br>GCTGCCTTGCAACAGAGCTTACAGAATGCTGAGTCCTG<br>GATCAACCGTTCAATTCAGGGATCGTCCACTTCTTCATC<br>CGCATCTTCTACGCTGTCCCACGGAGAGGTCAAAGGA<br>ACCAGTGGGTCTCTAGCTGATGTATTTGCCAATACTCG<br>AATAGAGAATTTCTCTGCTCCTCCTGATGTCACTACAAC<br>TACCTCTTCCTCCTCATCATCTTCCTCAATTCGCCCAGCA<br>AACATTGACCTGCCCCCCTCGGGGATAGTTAAAGGCAT<br>GCACAAAGGATCCAACAGGTCCAGCCTTATGGATACA<br>GCTGATGGTGTTCCTGTCAGTAGCAGAGTATCTACAAA<br>AATCCAGCAGCTTCTGAACACTCTGAAACGACCCAAAA<br>GGCCTCCCTTAAAGGAATTTTTTGTGGATGACTCTGAA<br>GAAATTGTGGAAGTACCTCAGCCAGACCCCAACCAGC<br>CCAAGCCGGAGGGACGGCAGATGACCCCTGTGAAAG<br>GAGAGCCTTTAGGAGTCATCTGTAACTGGCCTCCTGCT<br>CTTGAATCTGCCCTGCAGCGCTGGGGTACCACTCAAGC<br>AAAATGCTCCTGTCTGACTGCACTGGACATGACAGGG<br>AAACCAGTTTACACTCTTACATATGGAAAGTTGTGGAG<br>CAGAAGTTTAAAGTTGGCCTACACACTTCTTAATAAAC<br>TGGGGACCAAAAATGAACCTGTGTTAAAACCTGGAGA<br>CAGGGTAGCCCTGGTTTACCCCAACAATGATCCAGTCA<br>TGTTTATGGTGGCTTTCTATGGATGCCTCCTGGCAGAA<br>GTGATTCCAGTGCCTATAGAGGTACCTCTTACCAGAAA<br>GGATGCTGGAGGTCAGCAGATTGGCTTCTTGCTAGGA<br>AGCTGTGGTATTGCCTTAGCTCTTACCAGTGAAGTTTG<br>TCTAAAAGGACTGCCAAAAACCCAGAATGGAGAAATT<br>GTACAGTTTAAAGGTTGGCCCCGGCTCAAATGGGTTGT<br>AACAGATTCCAAGTACCTTTCAAAGCCACCGAAAGACT<br>GGCAGCCACACATCTCACCTGCTGGGACAGAACCGGC<br>ATACATTGAGTATAAAACAAGCAAAGAAGGGAGTGTA<br>ATGGGAGTTACAGTATCCCGGCTTGCAATGTTGTCTCA<br>CTGCCAAGCTCTGTCGCAGGCCTGCAATTATTCTGAAG<br>GGGAAACAATAGTAAATGTCTTAGACTTTAAGAAGGA<br>TGCTGGGCTGTGGCACGGCATGTTTGCGAATGTAATG<br>AATAAGATGCACACAATCAGCGTACCCTACTCTGTTAT<br>GAAAACCTGTCCTCTCTCTTGGGTCCAAAGAGTACATG<br>CTCACAAAGCCAAGGTAGCTTTAGTAAAATGTCGGGA<br>CTTGCACTGGGCTATGATGGCACATCGGGACCAAAGA<br>GACGTGAGCTTGAGTTCCCTCCGAATGTTAATTGTGAC<br>TGATGGAGCTAACCCCTGGTCCGTGTCATCCTGTGATG<br>CCTTCCTGAGTCTGTTCCAAAGTCATGGACTGAAGCCT<br>GAGGCCATCTGTCCGTGCGCCACGTCTGCTGAAGCCAT<br>GACTGTAGCAATCCGCAGGCCTGGAGTTCCAGGAGCC<br>CCTTTGCCAGGAAGAGCCATTCTCTCAATGAATGGATT<br>GAGCTATGGGGTAATACGGGTCAATACTGAAGATAAA<br>AATTCAGCACTGACGGTCCAGGATGTAGGGCATGTAA<br>TGCCTGGTGGGATGATGTGCATTGTGAAACCAGATGG<br>ACCTCCCCAGCTCTGCAAAACAGATGAAATTGGAGAA |

FIG. 27 Cont.

| sample | Gene Break point 5p | Gene Break point 3p | Frame Type | SEQ ID NO: | Fused Sequence |
|---|---|---|---|---|---|
| | | | | | ATCTGTGTTAGCTCCAGAACTGGAGGCATGATGTACTT TGGGCTTGCTGGTGTGACAAAAAATACATTTGAGGTA ATTCCAGTGAATTCTGCAGGCTCTCCTGTTGGGGATGT GCCATTCATCCGATCAGGATTGCTGGGGTTTGTAGGGC CGGGTAGTTTGGTGTTCGTGGTTGGGAAAATGGATGG CTTACTGATGGTTAGTGGTCGAAGACATAATGCTGATG ACATTGTTGCTACTGGATTGGCTGTAGAATCAATAAAG ACTGTTTATAGAGGAAGAATTGCTGTGTTTTCTGTGTC TGTATTTTATGATGAGCGCATTGTGGTGGTTGCGGAAC AAAGACCTGATGCTTCTGAGGAAGATAGTTTCCAGTG GATGAGCCGCGTGCTGCAGGCGATCGATAGCATTCAT CAAGTGGGGGTTTATTGTCTTGCTCTGGTGCCAGCCAA TACATTGCCAAAAACTCCACTAGGAGGAATCCATATAT CTCAGACGAAACAACTCTTTCTGGAGGGATCACTGCAT CCTTGCAACATCCTCATGTGCCCCCATACATGTGTGAC AAACTTGCCAAAGCCCCGGCAAAAACAACCAGGTGTA GGCCCTGCTTCCGTGATGGTTGGGAATCTGGTTGCTG GAAAACGTATAGCACAAGCTGCTGGAAGGGATCTGGG ACAAATAGAAGAGAATGATTTGGTGAGGAAGCACCAG TTTCTGGCAGAGATCCTACAGTGGCGAGCCCAGGCGA CTCCTGACCATGTACTCTTCATGCTGTTAAATGCCAAG GGAACCACTGTATGCACAGCCAGCTGCCTTCAGCTTCA TAAGCGAGCAGAGAGGATTGCATCTGTTCTTGGTGAT AAGGGACATCTAAATGCAGGAGATAATGTGGTGTTGC TCTATCCACCTGGCATTGAGTTAATCGCCGCCTTCTATG GCTGCCTGTATGCGGGCTGTATACCTGTGACCGTCAGA CCTCCACATGCTCAGAACCTCACGGCCACGCTGCCCAC TGTCCGAATGATTGTTGATGTCAGCAAAGCAGCCTGTA TTCTCACCAGTCAGACCCTAATGAGGCTACTGAGGTCC CGAGAGGCAGCAGCAGCTGTGGATGTGAAAACCTGG CCAACCATCATTGACACAGATGATTTACCCAGGAAAAG GTTACCTCAGCTGTATAAACCGCCCACTCCTGAGATGT TGGCATATCTTGATTTTAGTGTCTCCACAACTGGCATGC TTACAGGAGTGAAGATGTCCCACTCTGCAGTGAACGCT CTGTGTCGAGCCATCAAGCTCCAGTGTGAGTTGTACTC TTCTCGGCAGATCGCCATCTGCCTTGACCCTTACTGTG GACTTGGCTTCGCGCTCTGGTGTCTCTGCAGTGTCTAT TCAGGCCACCAGTCTGTCTTAATTCCTCCTATGGAGTTA GAGAACAACCTTTTCCTCTGGCTCTCCACAGTCAACCA GTACAAAATAAGGGACACTTTCTGCTCCTATTCAGTGA TGGAGCTCTGCACCAAAGGTCTTGGGAACCAAGTGGA AGTGCTAAAGACCAGAGGGATCAACCTCTCCTGCGTCC GGACCTGTGTGGTGGTGGCGGAGGAGAGGCCCCGCG TTGCACTCCAGCAGTCCTTCTCTAAGCTCTTCAAAGACA TCGGGCTGTCCCCGCGGGCTGTCAGCACCACTTTTGGA TCAAGAGTCAATGTAGCAATATGTTTACAGGGAACCTC AGGGCCTGATCCGACTACTGTGTATGTGGATCTGAAAT CACTAAGACATGACAGGGTTCGTCTCGTGGAACGTGG CGCCCCTCAGAGTTTGCTTCTCTCAGAGTCTGGAAAG\| AGATCGGGAAGTAAACAGTCCACTAACCCTGCCGATA ACTATCATCTGGCCCGGAGGAGAACCCTGCAGGTGGT TGTGAGCTCCTTGCTGACAGAGGCAGGGTTTGAGAGT GCCGAGAAAGCATCCGTGGAAACGCTGACAGAGATGC TGCAGAGCTACATTTCAGAAATTGGGAGAAGTGCCAA GTCTTACTGTGAGCACACAGCCAGGACCCAGCCCACAC |

FIG. 27 Cont.

| sample | Gene Break-point 5p | Gene Break-point 3p | Frame Type | SEQ ID NO: | Fused Sequence |
|---|---|---|---|---|---|
| | | | | | TGTCCGATATCGTGGTCACACTTGTTGAGATGGGTTTC AATGTGGACACTCTCCCTGCTTATGCAAAACGGTCTCA GAGGATGGTCATCACTGCTCCTCCGGTGACCAATCAGC CAGTGACCCCCAAGGCCCTCACTGCAGGGCAGAACCG ACCCCACCCGCCGCACATCCCCAGCCATTTTCCTGAGTT CCCTGATCCCCACACCTACATCAAAACTCCGACGTACC GTGAGCCCGTGTCAGACTACCAGGTCCTGCGGGAGAA GGCTGCATCCCAGAGGCGCGATGTGGAGCGGGCACTT ACCCGTTTCATGGCCAAGACAGGCGAGACTCAGAGTC TTTTCAAAGATGACGTCAGCACATTTCCATTGATTGCTG CCAGACCTTTCACCATCCCCTACCTGACAGCTCTTCTTC CGTCTGAACTGGAGATGCAACAAATGGAAGAGACAGA TTCCTCGGAGCAGGATGAACAGACAGACACAGAGAAC CTTGCTCTTCATATCAGCATGatagagtctcgctccgtcaccca ggctggagtgcagtggcaagatcttggctcactgcaacctccgcctcct gggttcaagcgattctccagcctcagcctcctgagtagctggaattaca gGAGGATTCTGGAGCCGAGAAGGAGAACACCTCTGTC CTGCAGCAGAACCCCTCCTTGTCGGGTAGCCGGAATG GGGAGGAGAACATCATCGATAACCCTTATCTGCGGCC GG |
| G17787. TCGA-26-5139-01A-01R-1850-01.4 | 139920034 | 156012704 | InFrame | 8373 | ATGGAACCCCCCGCGGCCAAGCGGAGCCGGGGCTGCC CCGCGGGACCCGAGGAGCGCGATgccggggccggggccgc gcgtggccggggccggcccgAGGCGCTGCTGGACCCTCAGCG CCAAGCGGGTAGCCGAGAGCTGGGCCTTCGAGCAGGT GGAGGAGCGGTTCTCCCGGGTGCCTGAGCCCGTCCAG AAGCGCATCGTGTTTTGGTCGTTTCCACGCAGTGAACG GGAAATATGTATGTACTCGTCGCTGGGTTACCCGCCCC CAGAGGGCGAGCACGATGCCCGGGTGCCCTTTACCCG CGGGCTGCACCTGCTCCAGAGCGGGGCCGTGGACCGC GTGTTGCAAGTGGGATTCCACCTGAGCGGAAACATCC GCGAGCCAGGGAGTCCTGGAGAGCCCGAGCGCCTCTA CCATGTCTCCATCAGCTTTGATCGCTGCAAGATCACGT CCGTGAGCTGCGGCTGTGACAACCGCGACCTCTTCTAC TGTGCCCACGTGGTGGCCCTGTCCCTGTACCGCATTCG GCACGCCCACCAGGTGGAGCTGCGGCTGCCCATCTCC GAGACGCTCTCCCAGATGAACCGGGACCAGCTGCAGA AGTTCGTGCAGTACCTCATCAGCGCCCATCACACTGAG GTGCTGCCCACTGCTCAGCGCTTGGCTGATGAGATCCT CCTGCTGGGCTCCGAGATCAACTTGGTGAATGGTGCCC CAGACCCCACCGCCGGCGCAGGAATCGAGGACGCCAA CTGCTGGCACCTGGACGAGGAGCAGATCCAGGAGCA GGTGAAGCAGCTACTGTCCAATGGCGGCTACTACGGG GCCAGCCAGCAGCTGCGCTCCATGTTCAGCAAGGTGC GGGAGATGCTGCGAATGCGGGACTCCAACGGGGCGC GCATGCTGATTCTCATGACCGAGCAGTTCCTGCAGGAC ACGCGCCTGGCCCTGTGGCGGCAGCAGGGCGCGGGC ATGACGGACAAGTGCCGGCAGCTCTGGGATGAGCTGG \|GGATGTTCAATAGCCCAGAAATGCAAGCCCTCCTCCA GCAGATCTCTGAGAACCCCCAGCTGATGCAGAATGTG ATCTCAGCACCCTACATGCGCAGCATGATGCAGACGCT TGCCCAGAACCCCGACTTTGCTGCTCAGATGATGGTGA ATGTGCCGCTCTTCGCGGGGAACCCCCAACTGCAGGA GCAGCTCCGCCTGCAGCTCCCAGTCTTCCTGCAGCAGA TGCAGAACCCAGAGTCACTCTCCATCCTTACCAATCCCC GAGCCATGCAGGCATTGCTGCAGATCCAGCAGGGACT |

FIG. 27 Cont.

| sample | Gene Break-point 5p | Gene Break-point 3p | Frame Type | SEQ ID NO: | Fused Sequence |
|---|---|---|---|---|---|
| | | | | | ACAGACCTTGCAGACCGAGGCCCCTGGGCTGGTACCCAGCCTTGGCTCCTTTGGGATATCCCGGACCCCAGCACCCTCAGCAGGCAGCAACGCAGGGTCTACGCCCGAGGCCCCCACTTCCTCACCAGCCACGCCAGCCACATCTTCTCCAACAGGGGCTTCCAGCGCCCAGCAGCAACTCATGCAGCAGATGATCCAGCTTTTGGCTGGAAGTGGAAACTCACAGGTGCAGACGCCAGAAGTGAGATTTCAGCAGCAGCTGGAGCAGCTCAACTCCATGGGCTTCATCAATCGTGAGGCTAACCTGCAGGCCCTGATTGCCACAGGAGGGGACATCAACGCAGCTATCGAGAGACTGCTGGGCTCCCAGCTCTCC |
| G17675.TCGA-19-2624-01A-01R-1850-01.2 | 65232631 | 63226059 | InFrame | 8374 | ATGGACGTCCTTCCCAccggcggggccgcccggggcTCCGGACGGAGCTGGAATTCCGCGGCGGCGGTGGCGAGGCGAGGCTGGAGAGTCAGGAGGAAGAAACGATTCCTGCAGCTCCCCCAGCCCCGCGCCTCCGGGGAGCGGCGGAGCGGCCGCGGCGCTCCCGGGACACGTGGGACGGCGATGAGGACACGGAGCCCGGCGAGGCGTGCGGCGGCCGCACAAGCCGCACGGCGTCCCTGGTGAGCGGGCTGCTCAACGAGCTGTACAGCTGCACAGAGGAGGAGGAggcggcgggcggggccgcggggccgagggccgccggcggcgccgcgACAGCCTCGACAGCTCCACCGAGGCCTCGGGCTCCGACGTGGTCCTGGGCGGCCGCCAGCGGTGCCGGCGACTCCCGCGTGCTGCAGGAGCTGCAGGAGCGACCGAGCCAGCGGCATCAGATGCTGTACCTGCGGCAGAAAGACGCTAATGAACTGAAGACGATCCTTCGAGAGCTAAAGTACAGAATTGGCATCCAGTCGGCCAAGTTACTTCGGCATCTGAAGCAGAAAGATAGGCTTCTGCATAAAGTGCAGAGGAACTGTGATATTGTGACTGCCTGCTTGCAGGCTGTGTCACAGAAGAGAAGAGTTGATACCAAGTTGAAATTCACTCTTGAGCCATCTTTAGGTCAAAATGGTTTTCAGCAGTGGTACGATGCTCTCAAGGCAGTTGCCAGGCTATCCACAGGAATACCAAAGGAATGGAGGAGAAAGGTTTGGTTGACCTTGGCAGATCATTATTTGCACAGTATAGCCATTGACTGGGACAAAACCATGCGCTTCACTTTCAATGAAAGGAGTAATCCTGATGATGACTCCATGGGAATTCAGATAGTCAAGGACCTTCACCGCACAGGCTGTAGTTCTTACTGTGGCCAGGAGGCTGAGCAGGACAGGGTTGTGTTGAAGCGGGTGCTGCTGGCCTATGCCCGATGGAACAAAACTGTTGGGTACTGCCAAGGCTTTAACATCCTGGCTGCACTAATTCTGGAAGTGATGGAAGGCAATGAAGGGGATGCCCTGAAAATTATGATTTACCTTATTGATAAGGTACTTCCCGAAAGCTATTTCGTCAATAATCTCCGGGCATTGTCTGTGGATATGGCTGTCTTCAGAGACCTTTTAAGAATGAAGCTGCCGGAATTATCTCAGCACCTGGATACTCTTCAGAGAACTGCAAACAAAGAAAGTGGAGGTGGATATGAGCCCCCACTTACAAATGTCTTCACGATGCAGTGGTTTCTGACTCTCTTTGCCACATGCCTCCCTAATCAGACCGTTTTAAAGATCTGGGATTCAGTCTTCTTTGAAGGTTCAGAAATCATCCTAAGGGTGTCGCTGGCTATCTGGGCAAAATTAGGAGA|GGTTATCAATGCCGGGAAGAGCACACACAATGAAGACCAAGCCAGCTGTGAGGTGCTCACTGTGAAGAAGAAGGCAGGGGCCGTGACCTCAACCCCAAACAGGAACTCATCCAAGAGACGGTCCTCCCTTCCCAATGGGAAGGGCTGCAGCTGAAGGAGAACTCGGAATCCGAGGGTGTTTCCTGCCACTATTGGTCGCTGTTTGACGGGCACGCGGGGTCCGGGGCCGC |

FIG. 27 Cont.

| sample | Gene Break-point 5p | Gene Break-point 3p | Frame Type | SEQ ID NO: | Fused Sequence |
|---|---|---|---|---|---|
| | | | | | GGTGGTGGCGTCACGCCTGCTGCAGCACCACATCACG GAGCAGCTGCAGGACATCGTGGACATCCTGAAGAACT CCGCCGTCCTGCCCCCTACCTGCCTGGGGGAGGAGCCT GAGAACACGCCCGCCAACAGCCGGACTCTGACCCGGG CAGCCTCCCTGCGCGGAGGGGTGGGGGCCCCGGGCTC CCCCAGCACGCCCCCCACACGCTTCTTTACCGAGAAGA AGATTCCCCATGAGTGCCTGGTCATCGGAGCGCTTGAA AGTGCATTCAAGGAAATGGACCTACAGATAGAACGAG AGAGGAGTTCATATAATATATCTGGTGGCTGCACGGC CCTCATTGTGATTTGCCTTTTGGGGAAGCTGTATGTTG CAAATGCTGGGGATAGCAGGGCCATAATCATCAGAAA TGGAGAAATTATCCCCATGTCTTCAGAATTTACCCCCG AGACGGAGCGCCAGCGACTTCAGTACCTGGCATTCAT GCAGCCTCACTTGCTGGGAAATGAGTTCACACATTTGG AGTTTCCAAGGAGAGTACAGAGAAAGGAGCTTGGAA AGAAGATGCTCTACAGGGACTTTAATATGACAGGCTG GGCATACAAAACCATTGAGGATGAGGACTTGAAGTTC CCCCTTATATATGGAGAAGGCAAGAAGGCCCGGGTAA TGGCAACTATTGGAGTGACCAGGGGACTTGGGGACCA TGACCTGAAGGTGCATGACTCCAACATCTACATTAAAC CATTCCTGTCTTCAGCTCCAGAGGTAAGAATCTACGAT CTTTCAAAATATGATCATGGATCAGATGATGTGCTGAT CTTGGCCACTGATGGACTCTGGGACGTTTTATCAAATG AAGAAGTAGCAGAAGCAATCACTCAGTTTCTTCCTAAC TGTGATCCAGATGATCCTCACAGGTACACACTGGCAGC TCAGGACCTGGTGATGCGTGCCCGGGGTGTGCTGAAG GACAGAGGATGGCGGATATCTAATGACCGACTGGGCT CAGGAGACGACATTTCTGTATATGTCATTCCTTTAATAC ATGGAAACAAGCTGTCA |
| G17800. TCGA-06-5859-01A-01R-1849-01.4 | 48586286 | 56936733 | InFrame | 8375 | ATGGACAATATGTCTATTACGAATACACCAACAAGTAA TGATGCCTGTCTGAGCATTGTGCATAGTTTGATGTGCC ATAGACAAGGTGGAGAGAGTGAAACATTTGCAAAAAG AGCAATTGAAAGTTTGGTAAAGAAGCTGAAGGAGAAA AAAGATGAATTGGATTCTTTAATAACAGCTATAACTAC AAATGGAGCTCATCCTAGTAAATGTGTTACCATACAGA GAACATTGGATGGGAGGCTTCAGGTGGCTGGTCGGAA AGGATTTCCTCATGTGATCTATGCCCGTCTCTGGAGGT GGCCTGATCTTCACAAAAATGAACTAAAACATGTTAAA TATTGTCAGTATGCGTTTGACTTAAAATGTGATAGTGT CTGTGTGAATCCATATCACTACGAACGAGTTGTATCAC CTGGAATTGATCTCTCAGGATTAACACTGCAGAGTAAT GCTCCATCAAGTATGATGGTGAAGGATGAATATGTGC ATGACTTTGAGGGACAGCCATCGTTGTCCACTGAAGG ACATTCAATTCAAACCATCCAGCATCCACCAAGTAATC GTGCATCGACAGAGACATACAGCACCCCAGCTCTGTTA GCCCCATCTGAGTCTAATGCTACCAGCACTGCCAACTT TCCCAACATTCCTGTGGCTTCCACAAGTCAGCCTGCCA GTATACTGGGGGGCAGCCATAGTGAAGGACTGTTGCA GATAGCATCAGGGCCTCAGCCAGGACAGCAGCAGAAT GGATTTACTGGTCAGCCAGCTACTTACCATCATAACAG CACTACCACCTGGACTGGAAGTAGGACTGCACCATAC ACACCTAATTTGCCTCACCACCAAAACGGCCATCTTCA GCACCACCCGCCTATGCCGCCCCATCCCGGACATTACT GGCCTGTTCACAATGAGCTTGCATTCCAGCCTCCCATTT CCAATCATCCTG\|GTGTGGTTCCAGAACCGACGGGC |

FIG. 27 Cont.

| sample | Gene Breakpoint 5p | Gene Breakpoint 3p | Frame Type | SEQ ID NO: | Fused Sequence |
|---|---|---|---|---|---|
| G17638. TCGA-28-2499-01A-01R-1850-01.2 | 234299129 | 234967480 | InFrame | 8376 | ATggcggcggcggcgggcgccccctccgccgggtcccccgcaaccgcct ccgccgccgccgcccgAGGAGTCGTCCGACAGCGAGCCCG AGGCGGAGCCCGGCTCCCCACAGAAGCTCATCCGCAA GGTGTCCACGTCGGGTCAGATCCGACAGAAGACCATC ATCAAAGAGGGGATGCTGACCAAACAGAACAATTCAT TCCAGCGATCAAAAAGGAGATACTTTAAGCTTCGAGG GCGAACGCTTTACTATGCCAAAACGGCAAAGTCAATCA TATTTGATGAGGTGGATCTGACAGATGCCAGCGTAGC TGAATCCAGTACCAAAAACGTCAACAACAGTTTTACG GTTGAGGTCCTAGATGAGAACAACTTGGTCATGAATTT AGAGTTCAGCATCCGGGAGACTACATGCAGGAAGGAT TCTGGAGAAGATCCCGCTACATGTGCCTTCCAGAGGG ACTACTATGTGTCCACAGCTGTTTGCAGAAGCACCGTG AAGGTATCTGCCCAGCAGGTGCAGGGCGTGCATGCTC GCTGCAGCTGGTCCTCCTCCACGTCTGAGTCTTACAGC AGCGAAGAGATGATTTTTGGGGACATGTTGGGATCTC ATAAATGGAGAAACAATTATCTATTTGGTCTCATTTCA GACGAGTCCATAAGTGAACAATTTTATGATCGGTCACT TGGGATCATGAGAAGGGTATTGCCTCCTGGAAACAGA AGGTACCCAAACCACCGGCACAGAGCAAGAATAAATA CTGACTTTGAG |

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17807 .TCGA-28-5209-01A-01R-1850-01.4 | 1 | 982 | 190 | 225 | 8377 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV | 24 | 6 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | WSYGVTVWELMTFGSKPYDGIPASEISSILEK GERLPQPPICTIDVYMIMVKCWMIDADSRPK FRELIIEFSKMARDPQRYLVIQDAFIGFGGNVI RQQVKDNAKWYITDFVELLGELEE | | |
| G17197 .TCGA-06-0211-01B-01R-1849-01.2 | 1 | 336 | 240 | 432 | 8378 | MGETMSKRLKLHLGGEAEMEERAFVNPFPDY EAAAGALLASGAAEETGCVRPPATTDEPGLPF HQDGKIIHNFIRRIQTKIKDLLQQMEEGLKTAD PHDCSAYTGWTGIALLYLQLYRVTCDQTYLLR SLDYVKRTLRNLNGRRVTFLCGDAGPLAVGAV IYHKLRSDCESQECVTKLLQLQRSVVCQESDLP DELLYGRAGYLYALLYLNTEIGPGTVCESAIKEV VNAIIESGKTLSREERKTERCPLLYQWHRKQYV GAAHGMAGIYYMLMQPAAKVDQETLTEMV KPSIDYVRHKKFRSGNYPSSLSNETDRLVHWC HGAPGVIHMLMQAYKGLLPFAVVGSTDEVK VGKRMVRGRHYPWGVLQVENENHCDFVKL RDMLLCTNMENLKEKTHTQHYECYRYQKLQK MGFTDVGPNNQPVSFQEIFEAKRQEFYDQC QREEEELKQRFMQRVKEKEATFKEAEKELQDK FEHLKMIQQEEIRKLEEEKKQLEGEIIDFYKMK AASEALQTQLSTDTKKDKHRKK | 6 | 7 |
| G17650 .TCGA-28-2513-01A-01R-1850-01.2 | 1 | 982 | 373 | 432 | 8379 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQLQDKFEHLKMI QQEEIRKLEEEKKQLEGEIIDFYKMKAASEALQ TQLSTDTKKDKHRKK | 24 | 10 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17506.TCGA-27-1835-01A-01R-1850-01.2 | 1 | 760 | 647 | 838 | 8380 | MGAPACALALCVAVAIVAGASSESLGTEQRV VGRAAEVPGPEPGQQEQLVFGSGDAVELSCP PPGGGPMGPTVWVKDGTGLVPSERVLVGPQ RLQVLNASHEDSGAYSCRQRLTQRVLCHFSVR VTDAPSSGDDEDGEDEAEDTGVDTGAPYWT RPERMDKKLLAVPAANTVRFRCPAAGNPTPSI SWLKNGREFRGEHRIGGIKLRHQQWSLVMES VVPSDRGNYTCVVENKFGSIRQTYTLDVLERS PHRPILQAGLPANQTAVLGSDVEFHCKVYSDA QPHIQWLKHVEVNGSKVGPDGTPYVTVLKS WISESVEADVRLRLANVSERDGGEYLCRATNF IGVAEKAFWLSVHGPRAAEEELVEADEAGSVY AGILSYGVGFFLFILVVAAVTLCRLRSPPKKGLG SPTVHKISRFPLKRQVSLESNASMSSNTPLVRI ARLSSGEGPTLANVSELELPADPKWELSRARLT LGKPLGEGCFGQVVMAEAIGIDKDRAAKPVT VAVKMLKDDATDKDLSDLVSEMEMMKMIG KHKNIINLLGACTQGGPLYVLVEYAAKGNLREF LRARRPPGLDYSFDTCKPPEEQLTFKDLVSCAY QVARGMEYLASQKCIHRDLAARNVLVTEDNV MKIADFGLARDVHNLDYYKKTTNGRLPVKW MAPEALFDRVYTHQSDVWSFGVLLWEIFTLG GSPYPGIPVEELFKLLKEGHRMDKPANCTHDL YMIMRECWHAAPSQRPTFKQLVEDLDRVLTV TSTDVKATQEENRELRSRCEELHGKNLELGKI MDRFEEVVYQAMEEVQKQKELSKAEIQKVLK EKDQLTTDLNSMEKSFSDLFKRFEKQKEVIEGY RKNEESLKKCVEDYLARITQEGQRYQALKAHA EEKLQLANEEIAQVRSKAQAEALALQASLRKE QMRIQSLEKTVEQKTKENEELTRICDDLISKME KI | 17 | 11 |
| G17191.TCGA-06-0211-01A-01R-1849-01.2 | 1 | 336 | 240 | 432 | 8381 | MGETMSKRLKLHLGGEAEMEERAFVNPFPDY EAAAGALLASGAAEETGCVRPPATTDEPGLPF HQDGKIIHNFIRRIQTKIKDLLQQMEEGLKTAD PHDCSAYTGWTGIALLYLQLYRVTCDQTYLLR SLDYVKRTLRNLNGRRVTFLCGDAGPLAVGAV IYHKLRSDCESQECVTKLLQLQRSVVCQESDLP DELLYGRAGYLYALLYLNTEIGPGTVCESAIKEV VNAIIESGKTLSREERKTERCPLLYQWHRKQYV GAAHGMAGIYYMLMQPAAKVDQETLTEMV KPSIDYVRHKKFRSGNYPSSLSNETDRLVHWC HGAPGVIHMLMQAYKGLLPFAVVGSTDEVK VGKRMVRGRHYPWGVLQVENENHCDFVKL RDMLLCTNMENLKEKTHTQHYECYRYQKLQK MGFTDVGPNNQPVSFQEIFEAKRQEFYDQC QREEEELKQRFMQRVKEKEATFKEAEKELQDK FEHLKMIQQEEIRKLEEEKKQLEGEIIDFYKMK AASEALQTQLSTDTKKDKHRKK | 6 | 7 |
| G17512.TCGA-27-1837-01A-01R- | 1 | 982 | 373 | 432 | 8382 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP | 24 | 10 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 1850-01.2 | | | | | | SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQLQDKFEHLKMI QQEEIRKLEEEKKQLEGEIIDFYKMKAASEALQ TQLSTDTKKDKHRKK | | |
| NYU_A | 1 | 760 | 548 | 838 | 8383 | MGAPACALALCVAVAIVAGASSESLGTEQRV VGRAAEVPGPEPGQQEQLVFGSGDAVELSCP PPGGGPMGPTVWVKDGTGLVPSERVLVGPQ RLQVLNASHEDSGAYSCRQRLTQRVLCHFSVR VTDAPSSGDDEDGEDEAEDTGVDTGAPYWT RPERMDKKLLAVPAANTVRFRCPAAGNPTPSI SWLKNGREFRGEHRIGGIKLRHQQWSLVMES VVPSDRGNYTCVVENKFGSIRQTYTLDVLERS PHRPILQAGLPANQTAVLGSDVEFHCKVYSDA QPHIQWLKHVEVNGSKVGPDGTPYVTVLKS WISESVEADVRLRLANVSERDGGEYLCRATNF IGVAEKAFWLSVHGPRAAEEELVEADEAGSVY AGILSYGVGFFLFILVVAAVTLCRLRSPPKKGLG SPTVHKISRFPLKRQVSLESNASMSSNTPLVRI ARLSSGEGPTLANVSELELPADPKWELSRARLT LGKPLGEGCFGQVVMAEAIGIDKDRAAKPVT VAVKMLKDDATDKDLSDLVSEMEMMKMIG KHKNIINLLGACTQGGPLYVLVEYAAKGNLREF LRARRPPGLDYSFDTCKPPEEQLTFKDLVSCAY QVARGMEYLASQKCIHRDLAARNVLVTEDNV MKIADFGLARDVHNLDYYKKTTNGRLPVKW MAPEALFDRVYTHQSDVWSFGVLLWEIFTLG GSPYPGIPVEELFKLLKEGHRMDKPANCTHDL YMIMRECWHAAPSQRPTFKQLVEDLDRVLTV TSTDFKESALRKQSLYLKFDPLLRDSPGRPVPV ATETSSMHGANETPSGRPREAKLVEFDFLGAL DIPVPGPPPGVPAPGGPPLSTGPIVDLLQYSQ | 17 | 8 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | KDLDAVVKATQEENRELRSRCEELHGKNLELG KIMDRFEEVVYQAMEEVQKQKELSKAEIQKVL KEKDQLTTDLNSMEKSFSDLFKRFEKQKEVIEG YRKNEESLKKCVEDYLARITQEGQRYQALKAH AEEKLQLANEEIAQVRSKAQAEALALQASLRK EQMRIQSLEKTVEQKTKENEELTRICDDLISKM EKI | | |
| G17814 .TCGA- 06- 5411- 01A- 01R- 1849- 01.4 | 1 | 834 | 399 | 796 | 8384 | MARQPPPPWVHAAFLLCLLSLGGAIEIPMDLT QPPTITKQSAKDHIVDPRDNILIECEAKGNPAP SFHWTRNSRFFNIAKDPRVSMRRRSGTLVIDF RSGGRPEEYEGEYQCFARNKFGTALSNRIRLQ VSKSPLWPKENLDPVVVQEGAPLTLQCNPPP GLPSPVIFWMSSSMEPITQDKRVSQGHNGDL YFSNVMLQDMQTDYSCNARFHFTHTIQQKN PFTLKVLTNHPYNDSSLRNHPDMYSARGVAE RTPSFMYPQGTASSQMVLRGMDLLLECIASG VPTPDIAWYKKGGDLPSDKAKFENFNKALRIT NVSEEDSGEYFCLASNKMGSIRHTISVRVKAA PYWLDEPKNLILAPGEDGRLVCRANGNPKPT VQWMVNGEPLQSAPPNPNREVAGDTIIFRD TQISSRAVYQCNTSNEHGYLLANAFVSVLDVP PRMLSPRNQLIRVILYNRTRLDCPFFGSPIPTLR WFKNGQGSNLDGGNYHVYENGSLEIKMIRKE DQGIYTCVATNILGKAENQVRLEVKDPTRIYR MPEDQVARRGTTVQLECRVKHDPSLKLTVSW LKDDEPLYIGNRMKKEDDSLTIFGVAERDQGS YTCVASTELDQDLAKAYLTVLADQATPTNRLA ALPKGRPDRPRDLELTDLAERSVRLTWIPGDA NNSPITDYVVQFEEDQFQPGVWHDHSKYPG SVNSAVLRLSPYVNYQFRVIAINEVGSSHPSLP SERYRTSGAPPESNPGDVKGEGTRKNNMEIT WTPMNATSAFGPNLRYIVKWRRRETREAWN NVTVWGSRYVVGQTPVYVPYEIRVQAENDFG KGPEPESVIGYSGEDYTNSTSGDPVEKKDETPF GVSVAVGLAVFACLFLSTLLLVLNKCGRRNKF GINRPAVLAPEDGLAMSLHFMTLGGSSLSPTE GKGSGLQGHIIENPQYFSDACVHHIKRRDIVLK WELGEGAFGKVFLAECHNLLPEQDKMLVAVK ALKEASESARQDFQREAELLTMLQHQHIVRFF GVCTEGRPLLMVFEYMRHGDLNRFLRSHGPD AKLLAGGEDVAPGPLGLGQLLAVASQVAAG MVYLAGLHFVHRDLATRNCLVGQGLVVKIGD FGMSRDIYSTDYYRVGGRTMLPIRWMPPESIL YRKFTTESDVWSFGVVLWEIFTYGKQPWYQL SNTEAIDCITQGRELERPRACPPEVYAIMRGC WQREPQQRHSIKDVHARLQALAQAPPVYLD VLG | 21 | 10 |
| G17223 .TCGA- 06- 0750- 01A- 01R- | 1 | 982 | 373 | 432 | 8385 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC | 24 | 10 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 1849-01.2 | | | | | | RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQLQDKFEHLKMI QQEEIRKLEEEKKQLEGEIIDFYKMKAASEALQ TQLSTDTKKDKHRKK | | |
| G17798 .TCGA-32-5222-01A-01R-1850-01.4 | 1 | 982 | 373 | 432 | 8386 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV | 24 | 10 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | WSYGVTVWELMTFGSKPYDGIPASEISSILEK GERLPQPPICTIDVYMIMVKCWMIDADSRPK FRELIIEFSKMARDPQRYLVIQLQDKFEHLKMI QQEEIRKLEEEKKQLEGEIIDFYKMKAASEALQ TQLSTDTKKDKHRKK | | |
| G17195 .TCGA- 06- 0138- 01A- 02R- 1849- 01.2 | 1 | 171 | 63 | 246 | 8387 | MFKRMAEFGPDSGGRVKGVTIVKPIVYGNVA RYFGKKREEDGHTHQWTVYVKPYRNEDMSA YVKKIQFKLHESYGNPLRVVTKPPYEITETGWG EFEIIIKIFFIDPNERPVTLYHLLKLFQSDTNAML GKKTVVSEFYDEMIFQDPTAMMQQLLTTSRQ LTLGAYKHETEYPYVKLLLDAMKHSGCAVNKD RHFSCEDCNGNVSGGFDASTSQIVLCQNNIH NQAHMNRVVTHELIHAFDHCRAHVDWFTNI RHLACSEVRAANLSGDCSLVNEIFRLHFGLKQ HHQTCVRDRATLSILAVRNISKEVAKKAVDEV FESCFNDHEPFGRIPHNKTYARYAHRDFENRD RYYSNI | 6 | 2 |
| G17803 .TCGA- 76- 4925- 01A- 01R- 1850- 01.4 | 1 | 760 | 612 | 838 | 8388 | MGAPACALALCVAVAIVAGASSESLGTEQRV VGRAAEVPGPEPGQQEQLVFGSGDAVELSCP PPGGGPMGPTVWVKDGTGLVPSERVLVGPQ RLQVLNASHEDSGAYSCRQRLTQRVLCHFSVR VTDAPSSGDDEDGEDEAEDTGVDTGAPYWT RPERMDKKLLAVPAANTVRFRCPAAGNPTPSI SWLKNGREFRGEHRIGGIKLRHQQWSLVMES VVPSDRGNYTCVVENKFGSIRQTYTLDVLERS PHRPILQAGLPANQTAVLGSDVEFHCKVYSDA QPHIQWLKHVEVNGSKVGPDGTPYVTVLKS WISESVEADVRLRLANVSERDGGEYLCRATNF IGVAEKAFWLSVHGPRAAEEELVEADEAGSVY AGILSYGVGFFLFILVVAAVTLCRLRSPPKKGLG SPTVHKISRFPLKRQVSLESNASMSSNTPLVRI ARLSSGEGPTLANVSELELPADPKWELSRARLT LGKPLGEGCFGQVVMAEAIGIDKDRAAKPVT VAVKMLKDDATDKDLSDLVSEMEMMKMIG KHKNIINLLGACTQGGPLYVLVEYAAKGNLREF LRARRPPGLDYSFDTCKPPEEQLTFKDLVSCAY QVARGMEYLASQKCIHRDLAARNVLVTEDNV MKIADFGLARDVHNLDYYKKTTNGRLPVKW MAPEALFDRVYTHQSDVWSFGVLLWEIFTLG GSPYPGIPVEELFKLLKEGHRMDKPANCTHDL YMIMRECWHAAPSQRPTFKQLVEDLDRVLTV TSTDVPGPPPGVPAPGGPPLSTGPIVDLLQYS QKDLDAVVKATQEENRELRSRCEELHGKNLEL GKIMDRFEEVVYQAMEEVQKQKELSKAEIQK VLKEKDQLTTDLNSMEKSFSDLFKRFEKQKEVI EGYRKNEESLKKCVEDYLARITQEGQRYQALK AHAEEKLQLANEEIAQVRSKAQAEALALQASL RKEQMRIQSLEKTVEQKTKENEELTRICDDLIS KMEKI | 17 | 10 |
| NYU_B | 1 | 31 | 214 | 548 | 8389 | MHGGGPPSGDSACPLRTIKRVQFGVLSPDEL VPVLRMVEGDTIYDYCWYSLMSSAQPDTSYV ASSSRENPIHIWDAFTGELRASFRAYNHLDELT AAHSLCFSPDGSQLFCGFNRTVRVFSTARPGR DCEVRATFAKKQGQSGIISCIAFSPAQPLYACG | 1 | 5 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | SYGRSLGLYAWDDGSPLALLGGHQGGITHLCF HPDGNRFFSGARKDAELLCWDLRQSGYPLWS LGREVTTNQRIYFDLDPTGQFLVSGSTSGAVS VWDTDGPGNDGKPEPVLSFLPQKDCTNGVSL HPSLPLLATASGQRVFPEPTESGDEGEELGLPL LSTRHVHLECRLQLWWCGGAPDSSIPDDHQ GEKGQGGTEGGVGELI | | |
| G17507 .TCGA- 28- 1747- 01C- 01R- 1850- 01.2 | 1 | 962 | 373 | 432 | 8390 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQLQDKFEHLKMI QQEEIRKLEEEKKQLEGEIIDFYKMKAASEALQ TQLSTDTKKDKHRKK | 24 | 10 |
| G17469 .TCGA- 06- 2557- 01A- 01R- 1849- 01.2 | 1 | 136 | 980 | 998 | 8391 | MADFDTYDDRAYSSFGGGRGSRGSAGGHGS RSQKELPTEPPYTAYVGNLPFNTVQGDIDAIFK DLSIRSVRLVRDKDTDKFKGFCYVEFDEVDSLK EALTYDGALLGDRSLRVDIAEGRKQDKGGFGF RKGGPDDREIKETDGSSQIKQEPDPTW | 4 | 34 |
| G17785 .TCGA- 06- 5413- 01A- 01R- | 1 | 106 | 119 | 239 | 8392 | MLTMSVTLSPLRSQDLDPMATDASPMAINM TPTVEQGEGEEAMKDMDSDQQYEKPPPLHT GADWKIVLHLPEIETWLRMTSERVRDLTYSVQ QDSDSKHVDVHLVQLKAMVACYPGNGTGYV RHVDNPNGDGRCITCIYYLNKNWDAKLHGGI LRIFPEGKSFIADVEPIFDRLLFFWSDRRNPHEV | 2 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 1849-01.4 | | | | | | QPSYATRYAMTVWYFDAEERAEAKKKFRNLTRKTESALTED | | |
| G17467.TCGA-14-0736-02A-01R-2005-01.2 | 1 | 83 | 103 | 348 | 8393 | MATEGGGKEMNEIKTQFTTREGLYKLLPHSEYSRPNRVPFNSQGSNPVRVSFVNLNDQSGNGDRLCFNVGRELYFYIYKGVRKEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ | 1 | 3 |
| GBM-CUMC3 316_L1 | 1 | 164 | 59 | 226 | 8394 | MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKALSLCNYFESQNVDFRGKKVIELGAGTGIVGILAALQGGDVTITDLPLALEQIQGNVQANVPAGGQAQVRALSWGIDHHVFPANYDLVLGADIVYLEPTFPLLLGTLQHLCRPHGTIYLASKMRKEHGTESFFQHLLPQHFQLELAQRDEDENVNIYRARHREPRPA | 3 | 2 |
| G17663.TCGA-19-2619-01A-01R-1850-01.2 | 1 | 876 | 417 | 796 | 8395 | MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYCREGLAQRNLPLIRCQENGRWEAPQISCVPRRPVSVAVGLAVFACLFLSTLLLVLNKCGRRNKFGINRPAVLAPEDGLAMSLHFMTLGGSSLSPTEGKGSGLQGHIIEN | 13 | 11 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | PQYFSDACVHHIKRRDIVLKWELGEGAFGKVF LAECHNLLPEQDKMLVAVKALKEASESARQD FQREAELLTMLQHQHIVRFFGVCTEGRPLLM VFEYMRHGDLNRFLRSHGPDAKLLAGGEDVA PGPLGLGQLLAVASQVAAGMVYLAGLHFVHR DLATRNCLVGQGLVVKIGDFGMSRDIYSTDYY RVGGRTMLPIRWMPPESILYRKFTTESDVWS FGVVLWEIFTYGKQPWYQLSNTEAIDCITQGR ELERPRACPPEVYAIMRGCWQREPQQRHSIK DVHARLQALAQAPPVYLDVLG | | |
| G17203 .TCGA-06-0211-02A-02R-2005-01.2 | 1 | 31 | 336 | 1210 | 8396 | MDQVMQFVEPSRQFVKDSIRLVKRCTKPDRK VCNGIGIGEFKDSLSINATNIKHFKNCTSISGDL HILPVAFRGDSFTHTPPLDPQELDILKTVKEITG FLLIQAWPENRTDLHAFENLEIIRGRTKQHGQ FSLAVVSLNITSLGLRSLKEISDGDVIISGNKNLC YANTINWKKLFGTSGQKTKIISNRGENSCKAT GQVCHALCSPEGCWGPEPRDCVSCRNVSRG RECVDKCNLLEGEPREFVENSECIQCHPECLP QAMNITCTGRGPDNCIQCAHYIDGPHCVKTC PAGVMGENNTLVWKYADAGHVCHLCHPNC TYGCTGPGLEGCPTNGPKIPSIATGMVGALLLL LVVALGIGLFMRRRHIVRKRTLRRLLQERELVE PLTPSGEAPNQALLRILKETEFKKIKVLGSGAFG TVYKGLWIPEGEKVKIPVAIKELREATSPKANK EILDEAYVMASVDNPHVCRLLGICLTSTVQLIT QLMPFGCLLDYVREHKDNIGSQYLLNWCVQI AKGMNYLEDRRLVHRDLAARNVLVKTPQHV KITDFGLAKLLGAEEKEYHAEGGKVPIKWMAL ESILHRIYTHQSDVWSYGVTVWELMTFGSKPY DGIPASEISSILEKGERLPQPPICTIDVYMIMVK CWMIDADSRPKFRELIIEFSKMARDPQRYLVI QGDERMHLPSPTDSNFYRALMDEEDMDDV VDADEYLIPQQGFFSSPSTSRTPLLSSLSATSNN STVACIDRNGLQSCPIKEDSFLQRYSSDPTGAL TEDSIDDTFLPVPEYINQSVPKRPAGSVQNPVY HNQPLNPAPSRDPHYQDPHSTAVGNPEYLNT VQPTCVNSTFDSPAHWAQKGSHQISLDNPDY QQDFFPKEAKPNGIFKGSTAENAEYLRVAPQS SEFIGA | 2 | 9 |
| G17784 .TCGA-76-4929-01A-01R-1850-01.4 | 1 | 150 | 98 | 245 | 8397 | MRQSLLFLTSVVPFVLAPRPPDDPGFGPHQRL EKLDSLLSDYDILSLSNIQQHSVRKRDLQTSTH VETLLTFSALKRHFKLYLTSSTERFSQNFKVVVV DGKNESEYTVKWQDFFTGHVVGEPDSRVLA HIRDDDVIIRINTDGAEYNIEELLDKYLIANATN PESKVFYLKMKGDYFRYLAEVACGDDRKQTID NSQGAYQEAFDISKKEMQPTHPIRLGLALNFS VFYYEILNNPELACTLAKTAFDEAIAELDTLNED SYKDSTLIMQLLRDNLTLWTSDSAGEECDAAE GAEN | 4 | 2 |
| G17675 .TCGA-19-2624-01A- | 1 | 228 | 559 | 584 | 8398 | MEEDGVRKCKKCEGPCRKVCNGIGIGEFKDSL SINATNIKHFKNCTSISGDLHILPVAFRGDSFTH TPPLDPQELDILKTVKEITGFLLIQAWPENRTD LHAFENLEIIRGRTKQQDQTTVSSVPTTLTAPT ASRPARQESWEKTTPWSGSTQTPAMCATCAI | 14 | 15 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 01R-1850-01.2 | | | | | | QTAPTDALGQVLKAVQRMGLRSRPSPLGW WGPSSCCWWWPWGSASSCEGATSFGSARC GGCCRRGRYRFDPRLMFSNRGSVRTRRFSKH LL | | |
| G17796 .TCGA-41-5651-01A-01R-1850-01.4 | 1 | 96 | 117 | 301 | 8399 | MADPGPDPESESESVFPREVGLFADSYSEKSQ FCFCGHVLTITQNFGSRLGVAARVWDAALSLC NYFESQNVDFRGKKVIELGAGTGIVGILAALQ VELSPLFPDTLILGLEIRVKVSDYVQDRIRALRA APAGGFQNIACLRSNAMKHLPNFFYKGQLTK MFFLFPDPHFKRTKHKWRIISPTLLAEYAYVLR VGGLVYTITDVLELHDWMCTHFEEHPLFERVP LEDLSEDPVVGHLGTSTEEGKKVLRNGGKNFP AIFRRIQDPVLQAVTSQTSLPGH | 2 | 3 |
| G17666 .TCGA-06-5415-01A-01R-1849-01.2 | 1 | 34 | 90 | 300 | 8400 | MVPAAGRRPPRVMRLLGWWQVLLWVLGLP VRGVEGYNVSLLYDLENLPASKDSIVHQAGML KRNCFASVFEKYFQFQEEGKEGENRAVIHYRD DETMYVESKKDRVTVVFSTVFKDDDDVVIGK VFMQEFKEGRRASHTAPQVLFSHREPPLELKD TDAAVGDNIGYITFVLFPRHTNASARDNTINLI HTFRDYLHYHIKCSKAYIHTRMRAKTSDFLKVL NRARPDAEKKEMKTITGKTFSSR | 1 | 6 |
| G17219 .TCGA-06-0158-01A-01R-1849-01.2 | 1 | 8 | 528 | 926 | 8401 | MDGFAGSLGTLHVGDEIREINGISVANQTVE QLQKMLREMRGSITFKIVPSYRTQSSSCERDS PSTSRQSPANGHSSTNNSVSDLPSTTQPKGR QIYVRAQFEYDPAKDDLIPCKEAGIRFRVGDII QIISKDDHNWWQGKLENSKNGTAGLIPSPEL QEWRVACIAMEKTKQEQQASCTWFGKKKKQ YKDKYLAKHNAVFDQLDLVTYEEVVKLPAFKR KTLVLLGAHGVGRRHIKNTLITKHPDRFAYPIP HTTRPPKKDEENGKNYYFVSHDQMMQDISN NEYLEYGSHEDAMYGTKLETIRKIHEQGLIAIL DVEPQALKVLRTAEFAPFVVFIAAPTITPGLNE DESLQRLQKESDILQRTYAHYFDLTIINNEIDETI RHLEEAVELVCTAPQWVPVSWVY | 1 | 17 |
| G17790 .TCGA-06-5856-01A-01R-1849-01.4 | 1 | 23 | 740 | 819 | 8402 | MSGQLERCEREWHELEGEFQELQDMKNATL SLNSNDSEPKYYPIAVLLKNQNQELPEDVNPA KKENYLSEQDFVSVFGITRGQFAALPGWKQL QMKKEKGLF | 1 | 18 |
| NYU_B | 1 | 93 | 4035 | 5204 | 8403 | MGGPQDKDERTIALVRPWPWGHQALDPAY GLDTMHPSRRSLPFPLNCQLARVGTADYGSP SDQSDQQLDCALDLMRRLPPQQIEKNLSDLID LDVPVEALTTVKPYCNEIHAQAQLWLKRDPK ASYDAWKKCLPIRGIDGNGKAPSKSELRHLYLT EKYVWRWKQFLSRRGKRTSPLDLKLGHNNW LRQVLFTPATQAARQAACTIVEALATIPSRKQ QVLDLLTSYLDELSIAGECAAEYLALYQKLITSA HWKVYLAARGVLPYVGNLITKEIARLLALEEAT LSTDLQQGYALKSLTGLLSSFVEVESIKRHFKSR LVGTVLNGYLCLRKLVVQRTKLIDETQDMLLE MLEDMTTGTESETKAFMAVCIETAKRYNLDD | 3 | 82 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | YRTPVFIFERLCSIIYPEENEVTEFFVTLEKDPQQ EDFLQGRMPGNPYSSNEPGIGPLMRDIKNKIC QDCDLVALLEDDSGMELLVNNKIISLDLPVAE VYKKVWCTTNEGEPMRIVYRMRGLLGDATEE FIESLDSTTDEEEDEEEVYKMAGVMAQCGGL ECMLNRLAGIRDFKQGRHLLTVLLKLFSYCVKV KVNRQQLVKLEMNTLNVMLGTLNLALVAEQ ESKDSGGAAVAEQVLSIMEIILDESNAEPLSED KGNLLLTGDKDQLVMLLDQINSTFVRSNPSVL QGLLRIIPYLSFGEVEKMQILVERFKPYCNFDKY DEDHSGDDKVFLDCFCKIAAGIKNNSNGHQL KDLILQKGITQNALDYMKKHIPSAKNLDADIW KKFLSRPALPFILRLLRGLAIQHPGTQVLIGTDSI PNLHKLEQVSSDEGIGTLAENLLEALREHPDV NKKIDAARRETRAEKKRMAMAMRQKALGTL GMTTNEKGQVVTKTALLKQMEELIEEPGLTCC ICREGYKFQPTKVLGIYTFTKRVALEEMENKPR KQQGYSTVSHFNIVHYDCHLAAVRLARGREE WESAALQNANTKCNGLLPVWGPHVPESAFA TCLARHNTYLQECTGQREPTYQLNIHDIKLLFL RFAMEQSFSADTGGGGRESNIHLIPYIIHTVLY VLNTTRATSREEKNLQGFLEQPKEKWVESAFE VDGPYYFTVLALHILPPEQWRATRVEILRRLLV TSQARAVAPGGATRLTDKAVKDYSAYRSSLLF WALVDLIYNMFKKQTTPTVGGIDTGSLEPCVC EKVPTSNTEGGWSCSLAEYIRHNDMPIYEAAD KALKTFQEEFMPVETFSEFLDVAGLLSEITDPES FLKDLLNSVP | | |
| G17657 .TCGA- 19- 1787- 01B- 01R- 1850- 01.2 | 1 | 89 | 39 | 797 | 8404 | MNGQLDLSGKLIIKAQLGEDIRRIPIHNEDITYD ELVLMMQRVFRGKLLSNDEVTIKYKDEDGDLI TIFDSSDLSFAIQCSRILKLTLFGKSTSSSSTPTEF CRNGGTWENGRCICTEEWKGLRCTIANFCEN STYMGFTFARIPVGRYGPSLQTCGKDTPNAG NPMAVRLCSLSLYGEIELQKVTIGNCNENLETL EKQVKDVTAPLNNISSEVQILTSDANKLTAENI TSATRVVGQIFNTSRNASPEAKKVAIVTVSQLL DASEDAFQRVAATANDDALTTLIEQMETYSLS LGNQSVVEPNIAIQSANFSSENAVGPSNVRFS VQKGASSSLVSSSTFIHTNVDGLNPDAQTELQ VLLNMTKNYTKTCGFVVYQNDKLFQSKTFTA KSDFSQKIISSKTDENEQDQSASVDMVFSPKY NQKEFQLYSYACVYWNLSAKDWDTYGCQKD KGTDGFLRCRCNHTTNFAVLMTFKKDYQYPK SLDILSNVGCALSVTGLALTVIFQIVTRKVRKTS VTWVLVNLCISMLIFNLLFVFGIENSNKNLQTS DGDINNIDFDNNDIPRTDTINIPNPMCTAIAAL LHYFLLVTFTWNALSAAQLYYLLIRTMKPLPRH FILFISLIGWGVPAIVVAITVGVIYSQNGNNPQ WELDYRQEKICWLAIPEPNGVIKSPLLWSFIVP VTIILISNVVMFITISIKVLWKNNQNLTSTKKVS SMKKIVSTLSVAVVFGITWILAYLMLVNDDSIR IVFSYIFCLFNTTQGLQIFILYTVRTKVFQSEASK VLMLLSSIGRRKSLPSVTRPRLRVKMYNFLRSL PTLHERFRLLETSPSTEEITLSESDNAKESI | 3 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17643 .TCGA-12-5295-01A-01R-1849-01.2 | 1 | 20 | 79 | 169 | 8405 | MAPARLFALLLFFVGGVAESDYKGQKLAEQM FQGIILFSAIVGFIYGYVAEQFGWTVYIVMAGF AFSCLLTLPPWPIYRRHPLKWLPVQESSTDDK KPGERKIKRHAKNN | 1 | 2 |
| NYU_G | 1 | 265 | 119 | 974 | 8406 | MRSIRKRWTICTISLLLIFYKTKEIARTEEHQET QLIGDGELSLSRSLVNSSDKIIRKAGSSIFQHNV EGWKINSSLVLEIRKNILRFLDAERDVSVVKSSF KPGDVIHYVLDRRRTLNISHDLHSLLPEVSPMK NRRFKTCAVVGNSGILLDSECGKEIDSHNFVIR CNLAPVVEFAADVGTKSDFITMNPSVVQRAF GGFRNESDREKFVHRLSMLNDSVLWIPAFMV KGGEKHVEWVNALILKNKLKVRTAYPSLRLIH AVRGFCDEGTCTDKANILYAWARNAPPTRLP KGVGFRVGGETGSKYFVLQVHYGDISAFRDN NKDCSGVSLHLTRLPQPLIAGMYLMMSVDTV IPAGEKVVNSDISCHYKNYPMHVFAYRVHTH HLGKVVSGYRVRNGQWTLIGRQSPQLPQAFY PVGHPVDVSFGDLLAARCVFTGEGRTEATHIG GTSSDEMCNLYIMYYMEAKHAVSFMTCTQN VAPDMFRTIPPEANIPIPVKSDMVMMHEHH KETEYKDKIPLLQQPKREEEEVLDQGDFYSLLS KLLGEREDVVHVHKYNPTEKAESESDLVAEIA NVVQKKDLGRSDAREGAEHERGNAILVRDRI HKFHRLVSTLRPPESRVFSLQQPPPGEGTWEP EHTGDFHMEEALDWPGVYLLPGQVSGVALD PKNNLVIFHRGDHVWDGNSFDSKFVYQQIGL GPIEEDTILVIDPNNAAVLQSSGKNLFYLPHGL SIDKDGNYWVTDVALHQVFKLDPNNKEGPVL ILGRSMQPGSDQNHFCQPTDVAVDPGTGAIY VSDGYCNSRIVQFSPSGKFITQWGEESSGSSPL PGQFTVPHSLALVPLLGQLCVADRENGRIQCF KTDTKEFVREIKHSSFGRNVFAISYIPGLLFAVN GKPHFGDQEPVQGFVMNFSNGEIIDIFKPVRK HFDMPHDIVASEDGTVYIGDAHTNTVWKFTL TEKLEHRSVKKAGIEVQEIKEAEAVVETKMEN KPTSSELQKMQEKQKLIKEPGSGVPVVLITTLL VIPVVVLLAIAIFIRWKKSRAFGADSEHKLETSS GRVLGRFRGKGSGGLNLGNFFASRKGYSRKG FDRLSTEGSDQEKEDDGSESEEEYSAPLPALAP SSS | 4 | 5 |
| G17494 .TCGA-14-2554-01A-01R-1850-01.2 | 1 | 85 | 67 | 170 | 8407 | MSVDMNSQGSDSNEEDYDPNCEEEEEEEED DPGDIEDYYVGVASDVEQQGADAFDPEEYQF TCLTYKESEGALNEHMTSLASVLKDGDPDTPK PVSFTVKETVCPRTTQQSPEDCDFKKDGLVKR CMGTVTLNQARGSFDISCDKDNKRFALLGDF FRKSKEKIGKEFKRIVQRIKDFLRNLVPRTES | 1 | 2 |
| G17196 .TCGA- | 1 | 852 | 922 | 996 | 8408 | MSRGAGALQRRTTTYLISLTLVKLESVPPPPPS PSAAAAGAAGARGSETGDPGSPRGAEEPGKK | 13 | 27 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 06-0178-01A-01R-1849-01.2 | | | | | | RHERLFHRQDALWISTSSAGTGGAEPPALSPA PASPARPVSPAPGRRLSLWAVPPGPPLSGGLS PDPKPGGAPTSSRRPLLSSPSWGGPEPEGRA GGGIPGSSSPHPGTGSRRLKVAPPPPAPKPCK TVTTSGAKAGGGKGAGSRLSWPESEGKPRVK GSKSSAGTGASVSAAATAAAAGGGGSTASTS GGVGAGAGARGKLSPRKGKSKTLDNSDLHPG PPAGSPPPLTLPPTPSPATAVTAASAQPPGPA PPITLEPPAPGLKRGREGGRASTRDRKMLKFIS GIFTKSTGGPPGSGPLPGPPSLSSGSGSRELLG AELRASPKAVINSQEWTLSRSIPELRLGVLGDA RSGKSSLIHRFLTGSYQVLEKTESEQYKKEMLV DGQTHLVLIREEAGAPDAKFSGWADAVIFVFS LEDENSFQAVSRLHGQLSSLRGEGRGGLALAL VGTQDRISASSPRVVGDARARALCADMKRCS YYETCATYGLNVDRVFQEVAQKVVTLRKQQQ LLAACKSLPSSPSHSAASTPVAGQASNGGHTS DYSSSLPSSPNVGHRELRAEAAAVAGLSTPGSL HRAAKRRTSLFANRRGSDSEKRSLDSRGETTG SGRAIPIKQSFLLKRSGNSLNKEWKKKYVTLSS NGFLLYHPSINDYIHSTHGKEMDLLRTTVKVP GKRPPRAISAFGPSASINGLVKDMSTVQMGE GLEATTPMPSPSPSPSSLQPPPDQTSKHLLKP DRNLARALSTDCTPSGDLSPLSREPPPSPMVK KQRRKKLTTPSKTEGSAGQAEDEGYSFSSVLYY GNEATLLIFDLLFFCVVDLACQNFILASFLTYLQ QEIFRYIRNTVGQKNLASKTLVDQRFLI | | |
| G17782.TCGA-26-5136-01B-01R-1850-01.4 | 1 | 19 | 140 | 216 | 8409 | MTHFNKGPSYGLSAEVKNKVLCNGPGTCVPI CVSALLLGILGIKKVIIVYVESICRVETLSMSGKIL FHLSDYFIVQWPALKEKYPKSVYLGRIV | 1 | 4 |
| GBM-CUMC3 296_L1 | 1 | 18 | 132 | 179 | 8410 | MRRQPAKVAALLLGLLLEHIEGDDLHIQRNVQ KLKDTVKKLGESGEIKAIGELDLLFMSLRNACI | 1 | 4 |
| G17199.TCGA-06-0744-01A-01R-1849-01.2 | 1 | 29 | 96 | 406 | 8411 | MRPSGTAGAALLALLAALCPASRALEEKKADI AQRYRISKYPTLKLFRNGMMMKREYRGQRSV KALADYIRQQKSDPIQEIRDLAEITTLDRSKRNII GYFEQKDSDNYRVFERVANILHDDCAFLSAFG DVSKPERYSGDNIIYKPPGHSAPDMVYLGAM TNFDVTYNWIQDKCVPLVREITFENGEELTEE GLPFLILFHMKEDTESLEIFQNEVARQLISEKGT INFLHADCDKFRHPLLHIQKTPADCPVIAIDSFR HMYVFGDFKDVLIPGKLKQFVFDLHSGKLHRE FHHGPDPTDTAPGEQAQDVASSPPESSFQKL APSEYRYTLLRDRDREL | 1 | 5 |
| G17792.TCGA-28-5204-01A- | 1 | 320 | 162 | 453 | 8412 | MTDGKLSTSTNGVAFMGILDGRPGNPLQNL QHVNLKAPRLLSAPEYGPKLKLRALEDRHSLQ SVDSGIPTLEIGNPEPVPCSAVHVRRKQSDSDL IPERAFQSACALPSCAPPAPSSTEREQSVRKSS TFPRTGYDSVKLYSPTSKALTRSDDVSVCSVSS | 4 | 3 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 01R-1850-01.4 | | | | | | LGTELSTTLSVSNEDILDLVVTSSSSAIVTLEND DDPQFTNVTLSSIKETRGLHQQDCVHEAEEGS KLKILGPFSNFFARNLLARKQSARLDKHNDLG WKLFGKAPLRENAQKDSKRIQKEYEDKAGRP SKPPSPKQNVRKNLDFEPLSTTALILEDRPAHP LFGRNVPLSSGSGFIMSEAGLIITNAHVVSSNS AAPGRQQLKVQLQNGDSYEATIKDIDKKSDIA TIKIHPKKKLPVLLLGHSADLRPGEFVVAIGSPF ALQNTVTTGIVSTAQREGRELGLRDSDMDYIQ TDAIINYGNSGGPLVNLDGEVIGINTLKVTAGI SFAIPSDRITRFLTEFQDKQIKDWKKRFIGIRM RTITPSLVDELKASNPDFPEVSSGIYVQEVAPN SPSQRGGIQDGDIIVKVNGRPLVDSSELQEAV LTESPLLLEVRRGNDDLLFSIAPEVVM | | |
| G17476 .TCGA-06-2569-01A-01R-1849-01.2 | 1 | 64 | 1974 | 3685 | 8413 | MRLLPRLLLLLLVFPATVLFRGGPRGLLAVAQ DLTEDEETVEDSIIEDEDDEAEVEEDEPTDLHT VREETMMVMTEDMPLEISYVPSTYLTEITHVS QALLEVEQLLNAPDLCAKDFEDLFKQEESLKNI KDSLQQSSGRIDIIHSKKTAALQSATPVERVKL QEALSQLDFQWEKVNKMYKDRQGRFDRSVE KWRRFHYDIKIFNQWLTEAEQFLRKTQIPEN WEHAKYKWYLKELQDGIGQRQTVVRTLNAT GEEIIQQSSKTDASILQEKLGSLNLRWQEVCKQ LSDRKKRLEEQKNILSEFQRDLNEFVLWLEEAD NIASIPLEPGKEQQLKEKLEQVKLLVEELPLRQ GILKQLNETGGPVLVSAPISPEEQDKLENKLKQ TNLQWIKVSRALPEKQGEIEAQIKDLGQLEKKL EDLEEQLNHLLLWLSPIRNQLEIYNQPNQEGP FDVKETEIAVQAKQPDVEEILSKGQHLYKEKPA TQPVKRKLEDLSSEWKAVNRLLQELRAKQPDL APGLTTIGASPTQTVTLVTQPVVTKETAISKLE MPSSLMLEVPALADFNRAWTELTDWLSLLDQ VIKSQRVMVGDLEDINEMIIKQKATMQDLEQ RRPQLEELITAAQNLKNKTSNQEARTIITDRIER IQNQWDEVQEHLQNRRQQLNEMLKDSTQW LEAKEEAEQVLGQARAKLESWKEGPYTVDAI QKKITETKQLAKDLRQWQTNVDVANDLALKL LRDYSADDTRKVHMITENINASWRSIHKRVSE REAALEETHRLLQQFPLDLEKFLAWLTEAETTA NVLQDATRKERLLEDSKGVKELMKQWQDLQ GEIEAHTDVYHNLDENSQKILRSLEGSDDAVLL QRRLDNMNFKWSELRKKSLNIRSHLEASSDQ WKRLHLSLQELLVWLQLKDDELSRQAPIGGDF PAVQKQNDVHRAFKRELKTKEPVIMSTLETVR IFLTEQPLEGLEKLYQEPRELPPEERAQNVTRLL RKQAEEVNTEWEKLNLHSADWQRKIDETLER LRELQEATDELDLKLRQAEVIKGSWQPVGDLLI DSLQDHLEKVKALRGEIAPLKENVSHVNDLAR QLTTLGIQLSPYNLSTLEDLNTRWKLLQVAVE DRVRQLHEAHRDFGPASQHFLSTSVQGPWE RAISPNKVPYYINHETQTTCWDHPKMTELYQS LADLNNVRFSAYRTAMKLRRLQKALCLDLLSLS AACDALDQHNLKQNDQPMDILQIINCLTTIYD RLEQEHNNLVNVPLCVDMCLNWLLNVYDTG | 2 | 42 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | RTGRIRVLSFKTGIISLCKAHLEDKYRYLFKQVA SSTGFCDQRRLGLLLHDSIQIPRQLGEVASFGG SNIEPSVRSCFQFANNKPEIEAALFLDWMRLE PQSMVWLPVLHRVAAAETAKHQAKCNICKE CPIIGFRYRSLKHFNYDICQSCFFSGRVAKGHK MHYPMVEYCTPTTSGEDVRDFAKVLKNKFRT KRYFAKHPRMGYLPVQTVLEGDNMETPVTLI NFWPVDSAPASSPQLSHDDTHSRIEHYASRLA EMENSNGSYLNDSISPNESIDDEHLLIQHYCQS LNQDSPLSQPRSPAQILISLESEERGELERILADL EEENRNLQAEYDRLKQQHEHKGLSPLPSPPE MMPTSPQSPRDAELIAEAKLLRQHKGRLEAR MQILEDHNKQLESQLHRLRQLLEQPQAEAKV NGTTVSSPSTSLQRSDSSQPMLLRVVGSQTSD SMGEEDLLSPPQDTSTGLEEVMEQLNNSFPSS RGRNTPGKPMREDTM | | |
| G17195 .TCGA- 06- 0138- 01A- 02R- 1849- 01.2 | 1 | 261 | 193 | 667 | 8414 | MPLLGQTVRSASARTRRWSRRAAGDRPGAP SEARRPQLRGDHGIVDRVRGHWRIAGSCSTC WCPSALCSSTNGFMCTFPNMSLTLVHFVVT WLGLYICQKLDIFAPKSLPPSRLLLLALSFCGFV VFTNLSLQNNTIGTYQLAKAMTTPVIIAIQTFC YQKTFSTRIQLTLIPITLGVILNSYYDVKFNFLG MVFAALGVLVTSLYQVWVGAKQHELQVNS MQLLYYQAPMSSAMLLVAVPFFEPVFGEGGI FGPWSVSALFLCDEGAGISGDYIDRVDEPLSCS YVLTIRTPRLCPHPLLRPPPSAAPQAILCHPSLQ PEEYMAYVQRQADSKQYGDKIIEELQDLGPQ VWSETKSGVAPQKMAGASPTKDDSKDSDFW KMLNEPEDQAPGGEEVPAEEQDPSPEAADSA SGAPNDFQNNVQVKVIRSPADLIRFIEELKGG TKKGKPNIGQEQPVDDAAEVPQREPEKERGD PERQREMEEEEDEDEDEDEDEDEDERQLLGEFE KELEGILLPSDRDRLRSEVKAGMERELENIIQET EKELDPDGLKKESERDRAMLALTSTLNKLIKRL EEKQSPELVKKHKKKRVVPKKPPPSPQPTEED PEHRVRVRVTKLRLGGPNQDLTVLEMKRENP QLKQIEGLVKELLEREGLTAAGKIEIKIVRPWAE GTEEGARWLTDEDTRNLKEIFFNILVPGAEEA QKERQRQKELESNYRRVWGSPGGEGTGDLD EFDF | 6 | 6 |
| G17212 .TCGA- 06- 0129- 01A- 01R- 1849- 01.2 | 1 | 810 | 134 | 341 | 8415 | MVPEAWRSGLVSTGRVVGVLLLLGALNKAST VIHYEIPEEREKGFAVGNVVANLGLDLGSLSAR RFRVVSGASRRFFEVNRETGEMFVNDRLDRE ELCGTLPSCTVTLELVVENPLELFSVEVVIQDIN DNNPAFPTQEMKLEISEAVAPGTRFPLESAHD PDVGSNSLQTYELSRNEYFALRVQTREDSTKY AELVLERALDREREPSLQLVLTALDGGTPALSA SLPIHIKVLDANDNAPVFNQSLYRARVLEDAPS GTRVVQVLATDLDEGPNGEIIYSFGSHNRAGV RQLFALDLVTGMLTIKGRLDFEDTKLHEIYIQA KDKGANPEGAHCKVLVEVVDVNDNAPEITVT SVYSPVPEDAPLGTVIALLSVTDLDAGENGLVT CEVPPGLPFSLTSSLKNYFTLKTSADLDRETVPE YNLSITARDAGTPSLSALTIVRVQVSDINDNPP | 1 | 4 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | QSSQSSYDVYIEENNLPGAPILNLSVWDPDAP QNARLSFFLLEQGAETGLVGRYFTINRDNGIVS SLVPLDYEDRREFELTAHISDGGTPVLATNISV NIFVTDRNDNAPQVLYPRPGGSSVEMLPRGT SAGHLVSRVVGWDADAGHNAWLSYSLLGSP NQSLFAIGLHTGQISTARPVQDTDSPRQTLTV LIKDNGEPSLSTTATLTVSVTEDSPEARAEFPSG SAPREQKKNLTFYLLLSLILVSVGFVVTVFGVIIF KVYKWKQSRDLYRAPVSSLYRTPGPSLHADAV RGGLMSPHLYHQVYLTTDSRRSDPLLKKPGAA SPLASRQNTLRSCDPVFYRQVLGAESAPPGQE EQNRGKPNWEHLNEDLHVLITVEDAQNRAEI KLKRAVEEVKKLLVPAAEGEDSLKKMQLMELA ILNGTYRDANIKSPALAFSLAATAQAAPRIITGP APVLPPAALRTPTPAGPTIMPLIRQIQTAVMP NGTPHPTAAIVPPGPEAGLIYTPYEYPYTLAPA TSILEYPIEPSGVLGAVATKVRRHDMRVHPYQ RIVTADRAATGN | | |
| G17213 .TCGA-06-0157-01A-01R-1849-01.2 | 1 | 12 | 131 | 278 | 8416 | MADIEQYYMKPPEIVKEAEVPQAALGVPAQG TGDNGHTPVEEEVGGIPVPAPGLLQVTERRQ PLSSVSSLEVHFDLLDLTELTDMSDQELAEVFA DSDDENLNTESPAGLHPLPRAGYLRSPSWTRT RAEQSHEKQPLGDPERQATVLDTFLTVERPQE D | 2 | 2 |
| G17200 .TCGA-06-0125-01A-01R-1849-01.2 | 1 | 1066 | 710 | 1072 | 8417 | MAAQVAPAAASSLGNPPPPPPSELKKAEQQQ REEAGGEAAAAAAAERGEMKAAAGQESEGP AVGPPQPLGKELQDGAESNGGGGGGGAGSG GGPGAEPDLKNSNGNAGPRPALNNNLTEPP GGGGGGSSDGVGAPPHSAAAALPPPAYGFG QPYGRSPSAVAAAAAAVFHQQHGGQQSPGL AALQSGGGGGLEPYAGPQQNSHDHGFPNH QYNSYYPNRSAYPPPAPAYALSSPRGGTPGSG AAAAAGSKPPPSSSASASSSSSSFAQQRFGAM GGGGPSAAGGGTPQPTATPTLNQLLTSPSSA RGYQGYPGGDYSGGPQDGGAGKGPADMAS QCWGAAAAAAAAAAASGGAQQRSHHAPM SPGSSGGGGQPLARTPQPSSPMDQMGKMR PQPYGGTNPYSQQQGPPSGPQQGHGYPGQ PYGSQTPQRYPMTMQGRAQSAMGGLSYTQ QIPPYGQQGPSGYGQQGQTPYYNQQSPHPQ QQQPPYSQQPPSQTPHAQPSYQQQPQSQPP QLQSSQPPYSQQPSQPPHQQSPAPYPSQQST TQQHPQSQPPYSQPQAQSPYQQQQPQQPA PSTLSQQAAYPQPQSQQSQQTAYSQQRFPPP QELSQDSFGSQASSAPSMTSSKGGQEDMNLS LQSRPSSLPDLSGSIDDLPMGTEGALSPGVSTS GISSSQGEQSNPAQSPFSPHTSPHLPGIRGPSP SPVGSPASVAQSRSGPLSPAAVPGNQMPPRP PSGQSDSIMHPSMNQSSIAQDRGYMQRNPQ MPQYSSPQPGSALSRQPSGGQIHTGMGSY QQNSMGSYGPQGGQYGPQGGYPRQPNYN ALPNANYPSAGMAGGINPMGAGGQMHGQ | 11 | 12 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | PGIPPYGTLPPGRMSHASMGNRPYGPNMAN MPPQVGSGMCPPPGGMNRKTQETAVAMH VAANSIQNRPPGYPNMNQGGMMGTGPPY GQGINSMAGMINPQGPPYSMGGTMANNSA GMAASPEMMGLGDVKLTPATKMNNKADGT PKTESKSKKSSSSTTTNEKITKLYELGGEPERKM WVDRYLAFTEEKAMGMTNLPAVGRKPLDLY RLYVSVKEIGGLTQMQALTSCECTICPDCFRQ HFTIALKEKHITDMVCPACGRPDLTDDTQLLS YFSTLDIQLRESLEPDAYALFHKKLTEGVLMRD PKFLWCAQCSFGFIYEREQLEATCPQCHQTFC VRCKRQWEEQHRGRSCEDFQNWKRMNDPE YQAQGLAMYLQENGIDCPKCKFSYALARGGC MHFHCTQCRHQFCSGCYNAFYAKNKCPEPN CRVKKSLHGHHPRDCLFYLRDWTALRLQKLLQ DNNVMFNTEPPAGARAVPGGGCRVIEQKEV PNGLRDEACGKETPAGYAGLCQAHYKEYLVSL INAHSLDPATLYEVEELETATERYLHVRPQPLA GEDPPAYQARLLQKLTEEVPLGQSIPRRRK | | |
| G17804 .TCGA-06-5408-01A-01R-1849-01.4 | 1 | 982 | 190 | 225 | 8418 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQDAFIGFGGNVI RQQVKDNAKWYITDFVELLGELEE | 24 | 6 |
| G17656 .TCGA-28- | 1 | 379 | 298 | 421 | 8419 | MAAQVAPAAASSLGNPPPPPPSELKKAEQQQ REEAGGEAAAAAAAERGEMKAAAGQESEGP AVGPPQPLGKELQDGAESNGGGGGGGAGSG | 1 | 5 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 2514-01A-02R-1850-01.2 | | | | | | GGPGAEPDLKNSNGNAGPRPALNNNLTEPP GGGGGGSSDGVGAPPHSAAAALPPPAYGFG QPYGRSPSAVAAAAAAVFHQQHGGQQSPGL AALQSGGGGGLEPYAGPQQNSHDHGFPNH QYNSYYPNRSAYPPPAPAYALSSPRGGTPGSG AAAAAGSKPPPSSSASASSSSSSFAQQRFGAM GGGGPSAAGGGTPQPTATPTLNQLLTSPSSA RGYQGYPGGDYSGGPQDGGAGKGPADMAS QCWGAAAAAAAAAAASGGAQQRSHHAPM SPGSSGGGGQPLARTPQVHLGSGIWVDEEK WHQLQVTQGDSKYTKNLAVMIWGTDVLKN RSVTGVATKKKKDAVPKPPLSPHKLSIVRECLY DRIAQETVDETEIAQRLSKVNKYICEKIMDINK SCKNEERREAKYNLQ | | |
| G17654 .TCGA-41-4097-01A-01R-1850-01.2 | 1 | 329 | 102 | 545 | 8420 | MLLSLPALHLQTSEHHPFFQLPHRRLGPWCSP TGSPAPLSCETGCGEGSWILVCRLLVPTQVSLL SMEEDIDTRKINNSFLRDHSYATEADIISTVEFN HTGELLATGDKGGRVVIFQREQESKNQVHRR GEYNVYSTFQSHEPEFDYLKSLEIEEKINKIRWL PQQNAAYFLLSTNDKTVKLWKVSERDKRPEG YNLKDEEGRLRDPATITTLRVPVLRPMDLMVE ATPRRVFANAHTYHINSISVNSDYETYMSADD LRINLWNFEITNQSFNIVDIKPANMEELTEVIT AAEFHPHHCNTFVYSSSKGTIRLCDMRASALC DRHTKSGEMLSVAEHFLEQQMHPTVVISAYR KALDDMISTLKKISIPVDISDSDMMLNIINSSIT TKAISRWSSLACNIALDAVKMVQFEENGRKEI DIKKYARVEKIPGGIIEDSCVLRGVMINKDVTH PRMRRYIKNPRIVLLDSSLEYKKGESQTDIEITR EEDFTRILQMEEEYIQQLCEDIIQLKPDVVITEK GISDLAQHYLMRANITAIRRVRKTDNNRIARA CGARIVSRPEELREDDVGTGAGLLEIKKIGDEY FTFITDCKDPKACTILLRGASKEILSEVERNLQD AMQVCRNVLLDPQLVPGGGASEMAVAHALT EKSKAMTGVEQWPYRAVAQALEVIPRTLIQN CGASTIRLLTSLRAKHTQENCETWGVNGETGT LVDMKELGIWEPLAVKLQTYKTAVETAVLLLRI DDIVSGHKKKGDDQSRQGGAPDAGQE | 7 | 6 |
| G17206 .TCGA-06-0125-02A-11R-2005-01.2 | 1 | 1066 | 710 | 1072 | 8421 | MAAQVAPAAASSLGNPPPPPPSELKKAEQQQ REEAGGEAAAAAAAERGEMKAAAGQESEGP AVGPPQPLGKELQDGAESNGGGGGGGAGSG GGPGAEPDLKNSNGNAGPRPALNNNLTEPP GGGGGGSSDGVGAPPHSAAAALPPPAYGFG QPYGRSPSAVAAAAAAVFHQQHGGQQSPGL AALQSGGGGGLEPYAGPQQNSHDHGFPNH QYNSYYPNRSAYPPPAPAYALSSPRGGTPGSG AAAAAGSKPPPSSSASASSSSSSFAQQRFGAM GGGGPSAAGGGTPQPTATPTLNQLLTSPSSA RGYQGYPGGDYSGGPQDGGAGKGPADMAS QCWGAAAAAAAAAAASGGAQQRSHHAPM SPGSSGGGGQPLARTPQPSSPMDQMGKMR PQPYGGTNPYSQQQGPPSGPQQGHGYPGQ PYGSQTPQRYPMTMQGRAQSAMGGLSYTQ QIPPYGQQGPSGYGQQGQTPYYNQQSPHPQ | 11 | 12 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | QQQPPYSQQPPSQTPHAQPSYQQQPQSQPP QLQSSQPPYSQQPSQPPHQQSPAPYPSQQST TQQHPQSQPPYSQPQAQSPYQQQQPQQPA PSTLSQQAAYPQPQSQQSQQTAYSQQRFPPP QELSQDSFGSQASSAPSMTSSKGGQEDMNLS LQSRPSSLPDLSGSIDDLPMGTEGALSPGVSTS GISSSQGEQSNPAQSPFSPHTSPHLPGIRGPSP SPVGSPASVAQSRSGPLSPAAVPGNQMPPRP PSGQSDSIMHPSMNQSSIAQDRGYMQRNPQ MPQYSSPQPGSALSPRQPSGGQIHTGMGSY QQNSMGSYGPQGGQYGPQGGYPRQPNYN ALPNANYPSAGMAGGINPMGAGGQMHGQ PGIPPYGTLPPGRMSHASMGNRPYGPNMAN MPPQVGSGMCPPPGGMNRKTQETAVAMH VAANSIQNRPPGYPNMNQGGMMGTGPPY GQGINSMAGMINPQGPPYSMGGTMANNSA GMAASPEMMGLGDVKLTPATKMNNKADGT PKTESKSKKSSSSTTTNEKITKLYELGGEPERKM WVDRYLAFTEEKAMGMTNLPAVGRKPLDLY RLYVSVKEIGGLTQMQALTSCECTICPDCFRQ HFTIALKEKHITDMVCPACGRPDLTDDTQLLS YFSTLDIQLRESLEPDAYALFHKKLTEGVLMRD PKFLWCAQCSFGFIYEREQLEATCPQCHQTFC VRCKRQWEEQHRGRSCEDFQNWKRMNDPE YQAQGLAMYLQENGIDCPKCKFSYALARGGC MHFHCTQCRHQFCSGCYNAFYAKNKCPEPN CRVKKSLHGHHPRDCLFYLRDWTALRLQKLLQ DNNVMFNTEPPAGARAVPGGGCRVIEQKEV PNGLRDEACGKETPAGYAGLCQAHYKEYLVSL INAHSLDPATLYEVEELETATERYLHVRPQPLA GEDPPAYQARLLQKLTEEVPLGQSIPRRRK | | |
| G17792 .TCGA- 28- 5204- 01A- 01R- 1850- 01.4 | 1 | 161 | 121 | 238 | 8422 | MAELDPFGAPAGAPGGPALGNGVAGAGEED PAAAFLAQQESEIAGIENDEAFAILDGGAPGP QPHGEPPGGPDAVDGVMNGEYYQESNGPT DSYAAISQVDRLQSEPESIRKWREEQMERLEA LDANSRKQEAEWKEKAIKELEEWYARQDEQL QKTKANNRTILLSVISLLNEPNTFSPANVDASV MFRKWRDSKGKDKEYAEIIRKQVSATKAEAEK DGVKVPTTLAEYCIKTKVPSNDNSSDLLYDDLY DDDIDDEDEEEEDADCYDDDDSGNEES | 4 | 4 |
| G17663 .TCGA- 19- 2619- 01A- 01R- 1850- 01.2 | 1 | 5 | 322 | 502 | 8423 | MSRPVRFMERNPLTNAIIRTTTALTIFKAGVKF NVIPPVAQATVNFRIHPGQTVQEVLELTKNIV ADNRVQFHVLSAFDPLPVSPSDDKALGYQLLR QTVQSVFPEVNITAPVTSIGNTDSRFFTNLTTG IYRFYPIYIQPEDFKRIHGVNEKISVQAYETQVK FIFELIQNADTDQEPVSHLHKL | 1 | 9 |
| NYU_E | 1 | 510 | 7 | 437 | 8424 | MRVAAATAAAGAGPAMAVWTRATKAGLVE LLLRERWVRVVAELSGESLSLTGDAAAAELEP ALGPAAAAFNGLPNGGGAGDSLPGSPSRGLG PPSPPAPPRGPAGEGASPPVRRVRVVKQEA GGLGISIKGGRENRMPILISKIFPGLAADQSRAL RLGDAILSVNGTDLRQATHDQAVQALKRAGK | 6 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | EVLLEVKFIREVTPYIKKPSLVSDLPWEGAAPQ SPSFSGSEDSGSPKHQNSTKDRKIIPLKMCFAA RNLSMPDLENRLIELHSPDSRNTLILRCKDTAT AHSWFVAIHTNIMALLPQVLAELNAMLGATS TAGGSKEVKHIAWLAEQAKLDGGRQQWRPV LMAVTEKDLLLYDCMPWTRDAWASPCHSYP LVATRLVHSGSGCRSPSLGSDLTFATRTGSRQ GIEMHLFRVETHRDLSSWTRILVQGCHAAAEL IKEVSLGCMLNGQEVRLTIHYENGFTISRENG GSSSILYRYPFERLKMSADDGIRNLYLDFGGPE GELKAIDLVTKATEEDKAKNYEEALRLYQHAVE YFLHAIKYEAHSDKAKESIRAKCVQYLDRAEKL KDYLRSKEKHGKKPVKENQSEGKGSDSDSEG DNPEKKKLQEQLMGAVVMEKPNIRWNDVA GLEGAKEALKEAVILPIKFPHLFTGKRTPWRGIL LFGPPGTGKSYLAKAVATEANNSTFFSVSSSDL MSKWLGESEKLVKNLFELARQHKPSIIFIDEVD SLCGSRNENESEAARRIKTEFLVQMQGVGNN NDGTLVLGATNIPWVLDSAIRRRFEKRIYIPLPE EAARAQMFRLHLGSTPHNLTDANIHELARKTE GYSGADISIIVRDSLMQPVRKVQSATHFKKVC GPSRTNPSMMIDDLLTPCSPGDPGAMEMT WMDVPGDKLLEPVVCMSDMLRSLATTRPTV NADDLLKVKKFSEDFGQES | | |
| NYU_G | 1 | 7 | 95 | 483 | 8425 | MKTPADTGDSGKVTTVVATLGQGPERSQEV AYTDIKVIGNGSFGVVYQARLAETRELVAIKKV LQDKRFKNRELQIMRKLDHCNIVRLRYFFYSSG EKKDELYLNLVLEYVPETVYRVARHFTKAKLTIP ILYVKVYMYQLFRSLAYIHSQGVCHRDIKPQNL LVDPDTAVLKLCDFGSAKQLVRGEPNVSYICS RYYRAPELIFGATDYTSSIDVWSAGCVLAELLL GQPIFPGDSGVDQLVEIIKVLGTPTREQIREM NPNYTEFKFPQIKAHPWTKVFKSRTPPEAIALC SSLLEYTPSSRLSPLEACAHSFFDELRCLGTQLP NNRPLPPLFNFSAGELSIQPSLNAILIPPHLRSP AGTTTLTPSSQALTETPTSSDWQSTDATPTLT NSS | 1 | 2 |
| NYU_B | 1 | 602 | 13 | 455 | 8426 | MGMARGSLTRVPGVMGEGTQGPELSLDPDP CSPQSTPGLMKGNKLEEQDPRPLQPIPGLME GNKLEEQDSSPPQSTPGLMKGNKREEQGLGP EPAAPQQPTAEEEALIEFHRSYRELFEFFCNNT TIHGAIRLVCSQHNRMKTAFWAVLWLCTFG MMYWQFGLLFGEYFSYPVSLNINLNSDKLVFP AVTICTLNPYRYPEIKEELEELDRITEQTLFDLYK YSSFTTLVAGSRSRRDLRGTLPHPLQRLRVPPP PHGARRARSVASSLRDNNPQVDWKDWKIGF QLCNQNKSDCFYQTYSSGVDAVREWYRFHYI NILSRLPETLPSLEEDTLGNFIFACRFNQVSCN QANYSHFHHPMYGNCYTFNDKNNSNLWMS SMPGINNGLSLMLRAEQNDFIPLLSTVTGARV MVHGQDEPAFMDDGGFNLRPGVETSISMRK ETLDRLGGDYGDCTKNGSDVPVENLYPSKYT QQVCIHSCFQESMIKECGCAYIFYPRPQNVEY CDYRKHSSWGYCYYKLQVDFSSDHLGCFTKCR | 11 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | KPCSVTSYQLSAGYSRWPSVTSQEWVFQMLS RQNNYTVNNKRNGVAKVNIFFKELNYKTNSE SPSVTVLLELLVGIYPSGVIGLVPHLGDREKRDS VCPQGKYIHPQNNSICCTKCHKGTYLYNDCPG PGQDTDCRECESGSFTASENHLRHCLSCSKCR KEMGQVEISSCTVDRDTVCGCRKNQYRHYW SENLFQCFNCSLCNGTVHLSCQEKQNTVCTC HAGFFLRENECVSCSNCKKSLECTKLCLPQIEN VKGTEDSGTTVLLPLVIFFGLCLLSLLFIGLMYR YQRWKSKLYSIVCGKSTPEKEGELEGTTTKPLA PNPSFSPTPGFTPTLGFSPVPSSTFTSSSTYTPG DCPNFAAPRREVAPPYQGADPILATALASDPI PNPLQKWEDSAHKPQSLDTDDPATLYAVVEN VPPLRWKEFVRRLGLSDHEIDRLELQNGRCLR EAQYSMLATWRRRTPRREATLELLGRVLRDM DLLGCLEDIEEALCGPAALPPAPSLLR | | |
| G17675 .TCGA- 19- 2624- 01A- 01R- 1850- 01.2 | 1 | 306 | 137 | 514 | 8427 | MVRSRQMCNTNMSVPTDGAVTTSQIPASEQ ETLVRPKPLLLKLLKSVGAQKDTYTMKEVLFYL GQYIMTKRLYDEKQQHIVYCSNDLLGDLFGVP SFSVKEHRKIYTMIYRNLVVVNQQESSDSGTS VSENRCHLEGGSDQKDLVQELQEEKPSSSHLV SRPSTSSRRRAISETEENSDELSGERQRKRHKS DSISLSFDESLALCVIREICCERSSSSESTGTPSN PDLDAGVSEHSGDWLDQDSVSDQFSVEFEVE SLDSEDYSLSEEGQELSDEDDEVYQVTVYQAG ESDTDSFEEDPEISLAESEGVSCHYWSLFDGH AGSGAAVVASRLLQHHITEQLQDIVDILKNSA VLPPTCLGEEPENTPANSRTLTRAASLRGGVG APGSPSTPPTRFFTEKKIPHECLVIGALESAFKE MDLQIERERSSYNISGGCTALIVICLLGKLYVAN AGDSRAIIIRNGEIIPMSSEFTPETERQRLQYLA FMQPHLLGNEFTHLEFPRRVQRKELGKKMLY RDFNMTGWAYKTIEDEDLKFPLIYGEGKKARV MATIGVTRGLGDHDLKVHDSNIYIKPFLSSAPE VRIYDLSKYDHGSDDVLILATDGLWDVLSNEE VAEAITQFLPNCDPDDPHRYTLAAQDLVMRA RGVLKDRGWRISNDRLGSGDDISVYVIPLIHG NKLS | 10 | 3 |
| G17484 .TCGA- 14- 0787- 01A- 01R- 1849- 01.2 | 1 | 2002 | 24 | 156 | 8428 | MDPRNTAMLGLGSDSEGFSRKSPSAISTGTLV SKREVELEKNTKEEEDLRKRNRERNIEAGKDD GLTDAQQQFSVKETNFSEGNLKLKIGLQAKRT KKPPKNLENYVCRPAIKTTIKHPRKALKSGKMT DEKNEHCPSKRDPSKLYKKADDVAAIECQSEE VIRLHSQGENNPLSKKLSPVHSEMADYINATP STLLGSRDPDLKDRALLNGGTSVTEKLAQLIAT CPPSKSSKTKPKKLGTGTTAGLVSKDLIRKAGV GSVAGIIHKDLIKKPTISTAVGLVTKDPGKKPVF NAAVGLVNKDSVKKLGTGTTAVFINKNLGKKP GTITTVGLLSKDSGKKLGIGIVPGLVHKESGKKL GLGTVVGLVNKDLGKKLGSTVGLVAKDCAKKI VASSAMGLVNKDIGKKLMSCPLAGLISKDAIN LKAEALLPTQEPLKASCSTNINNQESQELSESL KDSATSKTFEKNVVRQNKESILEKFSVRKEIINL EKEMFNEGTCIQQDSFSSSEKGSYETSKHEKQ | 6 | 4 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | PPVYCTSPDFKMGGASDVSTAKSPFSAVGES NLPSPSPTVSVNPLTRSPPETSSQLAPNPLLLSS TTELIEEISESVGKNQFTSESTHLNVGHRSVGH SISIECKGIDKEVNDSKTTHIDIPRISSSLGKKPSL TSESSIHTITPSVVNFTSLFSNKPFLKLGAVSAS DKHCQVAESLSTSLQSKPLKKRKGRKPRWTKV VARSTCRSPKGLELERSELFKNVSCSSLSNSNSE PAKFMKNIGPPSFVDHDFLKRRLPKLSKSTAPS LALLADSEKPSHKSFATHKLSSSMCVSSDLLSDI YKPKRGRPKSKEMPQLEGPPKRTLKIPASKVFS LQSKEEQEPPILQPEIEIPSFKQGLSVSPFPKKR GRPKRQMRSPVKMKPPVLSVAPFVATESPSK LESESDNHRSSSDFFESEDQLQDPDDLDDSHR PSVCSMSDLEMEPDKKITKRNNGQLMKTIIRK INKMKTLRKKLLNQILSSSVESSNKGKVQSKL HNTVSSLAATFGSKLGQQINVSKKGTIYIGKRR GRKPKTVLNGILSGSPTSLAVLEQTAQQAAGS ALGQILPPLLPSSASSSEILPSPICSQSSGTSGGQ SPVSSDAGFVEPSSVPYLHLHSRQGSMIQTLA MKKASKGRRRLSPPTLLPNSPSHLSELTSLKEA TPSPISESHSDETIPSDSGIGTDNNSTSDRAEKF CGQKKRRHSFEHVSLIPPETSTVLSSLKEKHKH KCKRRNHDYLSYDKMKRQKRKRKKKYPQLRN RQDPDFIAELEELISRLSEIRITHRSHHFIPRDLL PTIFRINFNSFYTHPSFPLDPLHYIRKPDLKKKR GRPPKMREAMAEMPFMHSLSFPLSSTGFYPS YGMPYSPSPLTAAPIGLGYYGRYPPTLYPPPPS PSFTTPLPPPSYMHAGHLLLNPAKYHKKKHKL LRQEAFLTTSRTPLLSMSTYPSVPPEMAYGW MVEHKHRHRHKHREHRSSEQPQVSMDTGSS RSVLESLKRYRFGKDAVGERYKHKEKHRCHMS CPHLSPSKSLINREEQWVHREPSESSPLALGLQ TPLQIDCSESSPSLSLGGFTPNSEPASSDEHTNL FTSAIGSCRVSNPNSSGRKKLTDSPGLFSAQDT SLNRLHRKESLPSNERAVQTLAGSQPTSDKPS QRPSESTNCSPTRKRSSSESTSSTVNGVPSRSP RLVASGDDSVDSLLQRMVQNEDQEPMEKSID AVIATASAPPSSSPGRSHSKDRTLGKPDSLLVP AVTSDSCNNSISLLSEKLTSSCSPHHIKRSVVEA MQRQARKMCNYDKILATKKNLDHVNKILKAK KLQRQARTGNNFVKRRPGRPRKCPLQAVVS MQAFQAAQFVNPELNRDEEGAALHLSPDTV TDVIEAVVQSVNLNPEHKKGLKRKGWLLEEQ TRKKQKPLPEEEEQENNKSFNEAPVEIPSPSET PAKPSEPESTLQPVLSLIPREKKPPRPPKKKYQK AGLYSDVYKTTDFSPGAGGFCTTLPPSFLRVD DRATSSTTDSSRAPSSPRPPGSTSHCGISTRCT ERCLCVLPLRTSQVPDVMAPQHDQEKFHDLA YSCLGKSFSMSNQDLYGYSTSSLALGLAWLSW ETKKKNVLHLVGLDSL | | |
| G17792 .TCGA- 28- 5204- | 1 | 326 | 21 | 206 | 8429 | MSGGKKKSSFQITSVTTDYEGPGSPGASDPPT PQPPTGPPPRLPNGEPSPDPGGKGTPRNGSP PPGAPSSRFRVVKLPHGLGEPYRRGRWTCVD VYERDLEPHSFGGLLEGIRGASGGAGGRSLDS | 4 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 01A-01R-1850-01.4 | | | | | | RLELASLGLGAPTPPSGLSQGPTSWLRPPPTSP GPQARSFTGGLGQLVVPSKAKAEKPPLSASSP QQRPPEPETGESAGTSRAATPLPSLRVEAEAG GSGARTPPLSRRKAVDMRLRMELGAPEEMG QVPPLDSRPSSPALYFTHDASLVHKSPDPFGA VAAQKFSLAHSMLAISGHLDSDDDSGSGSLV GIDNKIEQAMVFFWRQKIKPTISGHPDSKKHS LKKMEKTLQVVETLRLVELPKEAKPKLGESPEL ADPCVLAKTTEETEVELGQQGQSLLQLPRTAV KSVSTLMVSALQSGWQMCSWKSSVSSASVS SQVRTQSPLKTPEAELLWEVYLVLWAVRKHLR RLYRRQERHRRHHVRCHAAPRPNPAQSLKLD AQSPL | | |
| BT299 | 1 | 20 | 10 | 600 | 8430 | MALRRLGAALLLLPLLAAVEGAGQDVGRSCIL VSIAGKNVMLDCGMHMGFNDDRRFPDFSYI TQNGRLTDFLDCVIISHFHLDHCGALPYFSEM VGYDGPIYMTHPTQAICPILLEDYRKIAVDKKG EANFFTSQMIKDCMKKVVAVHLHQTVQVDD ELEIKAYYAGHVLGAAMFQIKVGSESVVYTGD YNMTPDRHLGAAWIDKCRPNLLITESTYATTI RDSKRCRERDFLKKVHETVERGGKVLIPVFALG RAQELCILLETFWERMNLKVPIYFSTGLTEKAN HYYKLFIPWTNQKIRKTFVQRNMFEFKHIKAF DRAFADNPGPMVVFATPGMLHAGQSLQIFR KWAGNEKNMVIMPGYCVQGTVGHKILSGQR KLEMEGRQVLEVKMQVEYMSFSAHADAKGI MQLVGQAEPESVLLVHGEAKKMEFLKQKIEQ ELRVNCYMPANGETVTLPTSPSIPVGISLGLLK REMAQGLLPEAKKPRLLHGTLIMKDSNFRLVS SEQALKELGLAEHQLRFTCRVHLHDTRKEQET ALRVYSHLKSVLKDHCVQHLPDGSVTVESVLL QAAAPSEDPGTKVLLVSWTYQDEELGSFLTSL LKKGLPQAPS | 1 | 2 |
| G17667 .TCGA-26-5134-01A-01R-1850-01.2 | 1 | 258 | 50 | 56 | 8431 | MNQPESANDPEPLCAVCGQAHSLEENHFYSY PEEVDDDLICHICLQALLDPLDTPCGHTYCTLC LTNFLVEKDFCPMDRKPLVLQHCKKSSILVNKL LNKLLVTCPFREHCTQVLQRCDLEHHFQTSCK GASHYGLTKDRKRRSQDGCPDGCASLTATAP SPEVSAAATISLMTDEPGLDNPAYVSSAEDGQ PAISPVDSGRSNRTRARPFERSTIRSRSFKKINR ALSVLRRTKSGSAVANHADQGRENSENTTAP EVWKHMLL | 4 | 4 |
| GBM-CUMC3 338_L1 | 1 | 432 | 8 | 609 | 8432 | MWLKVGGLLRGTGGQLGQTVGWPCGALGP GPHRWGPCGGSWAQKFYQDGPGRGLGEED IRRAREARPRKTPRPQLSDRSRERKVPASRISR LANFGGLAVGLGLGVLAEMAKKSMPGGRLQ SEGGSGLDSSPFLSEANAERIVQTLCTVRGAAL KVGQMLSIQDNSFISPQLQHIFERVRQSADF MPRWQMLRVLEEELGRDWQAKVASLEEVPF AAASIGQVHQGLLRDGTEVAVKIQYPGIAQSI QSDVQNLLAVLKMSAALPAGLFAEQSLQALQ QELAWECDYRREAACAQNFRQLLANDPFFRV PAVVKELCTTRVLGMELAGGVPLDQCQGLSQ DLRNQICFQLLTLCLRELFEFRFMQTDPNWAN | 14 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
|  |  |  |  |  |  | FLYDASSHQVTLLDFGASREFGTEFTDHYIEVV KAAADGDRDCVLQKSRDLKFLTGFETKGGPR RPERHLPPAPCGAPGPPETCRTEPDGAGTMN KLRQSLRRRKPAYVPEASRPHQWQADEDAVR KGTCSFPVRYLGHVEVEESRGMHVCEDAVKK LKAMGRKSVKSVLWVSADGLRVVDDKTKDLL VDQTIEKVSFCAPDRNLDKAFSYICRDGTTRR WICHCFLALKDSGERLSHAVGCAFAACLERKQ RREKECGVTAAFDASRTSFAREGSFRLSGGGR PAEREAPDKKKAEAAAAPTVAPGPAQPGHVS PTPATTSPGEKGEAGTPVAAGTTAAAIPRRHA PLEQLVRQGSFRGFPALSQKNSPFKRQLSLRL NELPSTLQRRTDFQVKGTVPEMEPPGAGDSD SINALCTQISSSFASAGAPAPGPPPATTGTSA WGEPSVPPAAAFQPGHKRTPSEAERWLEEVS QVAKAQQQQQQQQQQQQQQQQQQQQQQA ASVAPVPTMPPALQPFPAPVGPFDAAPAQVA VFLPPPHMQPPFVPAYPGLGYPPMPRVPVVG ITPSQMVANAFCSAAQLQPQPATLLGKAGAF PPPAIPSAPGSQARPRPNGAPWPPEPAPAPA PELDPFEAQWAALEGKATVEKPSNPFSGDLQ KTFEIEL |  |  |
| G17815 .TCGA- 19- 5960- 01A- 11R- 1850- 01.4 | 1 | 700 | 32 | 192 | 8433 | MASCPDSDNSWVLAGSESLPVETLGPASRM DPESERALQAPHSPSKTDGKELAGTMDGEGT LFQTESPQSGSILTEETEVKGTLEGDVCGVEPP GPGDTVVQGDLQETTVVTGLGPDTQDLEGQ SPPQSLPSTPKAAWIREEGRCSSSDDDTDVD MEGLRRRRGREAGPPQPMVPLAVENQAGG EGAGGELGISLNMCLLGALVLLGLGVLLFSGGL SESETGPMEEVERQVLPDPEVLEAVGDRQDG LREQLQAPVPPDSVPSLQNMGLLLDKLAKEN QDIRLLQAQLQAQKEELQSLMHQPKGLEEEN AQLRGALQQGEAFQRALESELQQLRARLQGL EADCVRGPDGVCLSGGRGPQGDKAIREQGP REQEPELSFLKQKEQLEAEAQALRQELERQRR LLGSVQQDLERSLQDASRGDPAHAGLAELGH RLAQKLQGLENWGQDPGVSANASKAWHQK SHFQNSREWSGKEKWWDGQRDRKAEHWK HKKEESGRERKKNWGGQEDREPAGRWKEGR PRVEESGSKKEGKRQGPKEPPRKSGSFHSSGE KQKQPRWREGTKDSHDPLPSWAELLRPKYRA PQGCSGVDECARQEGLTFFGTELAPVRQQEL ASLLRTYLARLPWAGQLTKELPLSPAFFGEDGI FRHDRLRFRDFVDALEDSLEEVAVQQTGDDD EVDDFEDFIFSHFFGDKALKKRLGADVCAVLRL SGPLKEQYAQEHGLNFQRLLDTSTYKEAFRKD MIRWGEEKRQADPGFFCRKIVEGISQPIWLVS DTRRVSDIQWFREAYGAVTQTVRVVALEQSR QQRGWVFTPGVDDAESECGLDNFGDFDWVI ENHGVEQRLEEQLENLIEFIRSRL | 10 | 2 |
| G17662 .TCGA- 32- 1970- | 1 | 81 | 23 | 977 | 8434 | MEARSMLVPPQASVCFEDVAMAFTQEEWE QLDLAQRTLYREVTLETWEHIVSLGLFLSKSDV ISQLEQEEDLCRAEQEAPRGKSKEAEIKRINKEL ANIRSKFKGDKALDGYSKKKYVCKLLFIFLLGH | 3 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 01A-01R-1850-01.2 | | | | | | DIDFGHMEAVNLLSSNKYTEKQIGYLFISVLVN SNSELIRLINNAIKNDLASRNPTFMCLALHCIA NVGSREMGEAFAADIPRILVAGDSMDSVKQS AALCLLRLYKASPDLVPMGEWTARVVHLLND QHMGVVTAAVSLITCLCKKNPDDFKTCVSLAV SRLSRIVSSASTDLQDYTYYFVPAPWLSVKLLRL LQCYPPPEDAAVKGRLVECLETVLNKAQEPPK SKKVQHSNAKNAILFETISLIIHYDSEPNLLVRA CNQLGQFLQHRETNLRYLALESMCTLASSEFS HEAVKTHIDTVINALKTERDVSRQRAADLLY AMCDRSNAKQIVSEMLRYLETADYAIREEIVLK VAILAEKYAVDYSWYVDTILNLIRIAGDYVSEE VWYRVLQIVTNRDDVQGYAAKTVFEALQAPA CHENMVKVGGYILGEFGNLIAGDPRSSPPVQF SLLHSKFHLCSVATRALLLSTYIKFINLFPETKATI QGVLRAGSQLRNADVELQQRAVEYLTLSSVA STDVLATVLEEMPPFPERESSILAKLKRKKGPG AGSALDDGRRDPSSNDINGGMEPTPSTVSTP SPSADLLGLRAAPPPAAPPASAGAGNLLVDVF DGPAAQPSLGPTPEEAFLSELEPPAPESPMALL ADPAPAADPGPEDIGPPIPEADELLNKFVCKN NGVLFENQLLQIGVKSEFRQNLGRMYLFYGN KTSVQFQNFSPTVVHPGDLQTHLAVQTKRVA AQVDGGAQVQQVLNIECLRDFLTPPLLSVRFR YGGAPQALTLKLPVTINKFFQPTEMAAQDFF QRWKQLSLPQQEAQKIFKANHPMDAEVTKA KLLGFGSALLDNVDPNPENFVGAGIIQTKALQ VGCLLRLEPNAQAQMYRLTLRTSKEPVSRHLC ELLAQQF | | |
| NYU_E | 1 | 416 | 3 | 148 | 8435 | MASESGKLWGGRFVGAVDPIMEKFNASIAYD RHLWEVDVQGSKAYSRGLEKAGLLTKAEMD QILHGLDKVAEEWAQGTFKLNSNDEDIHTAN ERRLKELIGATAGKLHTGRSNDQVVTDLRLW MRQTCSTLSGLLWELIRTMVDRAEAERDVLF PGYTHLQRAQPIRWSHWILSHAVALTRDSERL LEVRKRINVLPLGSGAIAGNPLGVDRELLRAEL NFGAITLNSMDATSERDFVAEFLFWASLCMT HLSRMAEDLILYCTKEFSFVQLSDAYSTGSSLM PQKKNPDSLELIRSKAGRVFGRCAGLLMTLKG LPSTYNKDLQEDKEAVFEVSDTMSAVLQVAT GVISTLQIHQENMGQALSPDMLATDLAYYLV RKGMPFRQAHEASGKAVFMAETKGVALNQL SLQELQTIRKDANSALLSNYEVFQLLTDLKEQR KESGKNKHSSGQQNLNTITYETLKYISKTPCRH QSPEIVREFLTALKSHKLTKAEKLQLLNHRPVT AVEIQLMVEESEERLTEEQIEALLHTVTSILPAE PEAEQKKNTNSNVAMDEEDPA | 15 | 2 |
| G17816 .TCGA-28-5215-01A-01R- | 1 | 982 | 190 | 225 | 8436 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC | 24 | 6 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 1850-01.4 | | | | | | RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQDAFIGFGGNVI RQQVKDNAKWYITDFVELLGELEE | | |
| G17650 .TCGA-28-2513-01A-01R-1850-01.2 | 1 | 68 | 18 | 432 | 8437 | MGETMSKRLKLHLGGEAEMEERAFVNPFPDY EAAAGALLASGAAEETGCVRPPATTDEPGLPF HQDGKQKENNIRCLTTIGHFGFECLPNQLVSR SIRQGFTFNILCVGETGIGKSTLIDTLFNTNLKD NKSSHFYSNVGLQIQTYELQESNVQLKLTVVE TVGYGDQIDKEASYQPIVDYIDAQFEAYLQEEL KIKRSLFEYHDSRVHVCLYFISPTGHSLKSLDLLT MKNLDSKVNIIPLIAKADTISKNDLQTFKNKIM SELISNGIQIYQLPTDEETAAQANSSVSGLLPFA VVGSTDEVKVGKRMVRGRHYPWGVLQVEN ENHCDFVKLRDMLLCTNMENLKEKTHTQHYE CYRYQKLQKMGFTDVGPNNQPVSFQEIFEAK RQEFYDQCQREEEELKQRFMQRVKEKEATFK EAEKELQDKFEHLKMIQQEEIRKLEEEKKQLEG EIIDFYKMKAASEALQTQLSTDTKKDKHRKK | 1 | 3 |
| BT308 | 1 | 176 | 2050 | 2063 | 8438 | MAAPLVLVLVVAVTVRAALFRSSLAEFISERVE VVSPLSSWKRVVEGLSLLDLGVSPYSGAVFHE TPLIIYLFHFLIDYAELVFMITDALTAIALYFAIQD FNKVVFKKQKLLLELDQYAPDVAELIRTPMEM RYIPLKVALFYLLNPYTILSCVAKSTCAINNTLIA FFILTTIKDITSAVQSKRRKSK | 6 | 16 |
| G17656 .TCGA-28-2514-01A-02R-1850-01.2 | 1 | 982 | 18 | 172 | 8439 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF | 24 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQCTEAKKHCWYF EGLYPTYYICRSYEDCCGSRCCVRALSIQRLWY FWFLLMMGVLFCCGAGFFIRRRMYPPPLIEEP AFNVSYTRQPPNPGPGAQQPGPPYYTDPGG PGMNPVGNSMAMAFQVPPNSPQGSVACPP PPAYCNTPPPPYEQVVKAK | | |
| G17639 .TCGA-12-3652-01A-01R-1849-01.2 | 1 | 344 | 94 | 262 | 8440 | MAEAPPVSGTFKFNTDAAEFIPQEKKNSGLNC GTQRRLDSNRIGRRNYSSPPPCHLSRQVPYDE ISAVHQHSYHPSGSKPKSQQTSFQSSPCNKSP KSHGLQNQPWQKLRNEKHHIRVKKAQSLAE QTSDTAGLESSTRSESGTDLREHSPSESEKEVV GADPRGAKPKKATQFVYSYGRGPKVKGKLKC EWSNRTTPKPEDAGPESTKPVGVFHPDSSEAS SRKGVLDGYGARRNEQRRYPQKRPPWEVEG ARPRPGRNPPKQEGHRHTNAGHRNNMGPIP KDDLNERPAKSTCDSENLAVINKSSRRVDQEK CTVRRQDPQVVSPFSRGKQNHVLKNVETHTA DKCSPNYLGSDWYNTWRMEPYNSSCCNKYT TYLPRLPKEARMETAVRGMPLECPPRPERLNA YEREVMVNMLNSLSRNQQLPRITPRCGCVDP LPGRLPFHGYESACSGRHYCLRGMDYYASGA PCTDRRLRPWCREQPTMCTSLRAPARNAVCC YNSPAVILPISEP | 2 | 3 |
| G17796 .TCGA-41-5651-01A-01R-1850-01.4 | 1 | 193 | 167 | 1032 | 8441 | MAAETLLSSLLGLLLLGLLLPASLTGGVGSLNLE ELSEMRYGIEILPLPVMGGQSQSSDVVIVSSKY KQRYECRLPAGAIHFQREREEETPAYQGPGIP ELLSPMRDAPCLLKTKDWWTYEFCYGRHIQQ YHMEDSEIKGEVLYLGYYQSAFDWDDETAKA SKQHRLKRYHSQTYGNGSKCDLNGRPREAEV RGCTERFVSSPEEILDVIDEGKSNRHVAVTNM NEHSSRSHSIFLINIKQENMETEQKLSGKLYLV DLAGSEKVSKTGAEGAVLDEAKNINKSLSALG | 5 | 7 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | NVISALAEGTKSYVPYRDSKMTRILQDSLGGN CRTTMFICCSPSSYNDAETKSTLMFGQRAKTIK NTASVNLELTAEQWKKKYEKEKEKTKAQKETI AKLEAELSRWRNGENVPETERLAGEEAALGA ELCEETPVNDNSSIVVRIAPEERQKYEEEIRRLY KQLDDKDDEINQQSQLIEKLKQQMLDQEELL VSTRGDNEKVQRELSHLQSENDAAKDEVKEV LQALEELAVNYDQKSQEVEEKSQQNQLLVDE LSQKVATMLSLESELQRLQEVSGHQRKRIAEV LNGLMKDLSEFSVIVGNGEIKLPVEISGAIEEEF TVARLYISKIKSEVKSVVKRCRQLENLQVECHR KMEVTGRELSSCQLLISQHEAKIRSLTEYMQSV ELKKRHLEESYDSLSDELAKLQAQETVHEVALK DKEPDTQDADEVKKALELQMESHREAHHRQ LARLRDEINEKQKTIDELKDLNQKLQLELEKLQ ADYEKLKSEEHEKSTKLQELTFLYERHEQSKQD LKGLEETVARELQTLHNLRKLFVQDVTTRVKKS AEMEPEDSGGIHSQKQKISFLENNLEQLTKVH KQLVRDNADLRCELPKLEKRLRATAERVKALE GALKEAKEGAMKDKRRYQQEVDRIKEAVRYK SSGKRGHSAQIAKPVRPGHYPASSPTNPYGTR SPECISYTNSLFQNYQNLYLQATPSSTSDMYFA NSCTSSGATSSGGPLASYQKANMDNGNATDI NDNRSDLPCGYEAEDQAKLFPLHQETAAS | | |
| G17468.TCGA-19-0957-02A-11R-2005-01.2 | 1 | 209 | 176 | 342 | 8442 | MKLADSVMAGKASDGSIKWQLCYDISARTW WMDEFHPFIEALLPHVRAFAYTWFNLQARKR KYFKKHEKRMSKEEERAVKDELLSEKPEVKQK WASRLLAKLRKDIRPEYREDFVLTVTGKKPPCC VLSNPDQKGKMRRIDCLRQADKVWRLDLVM VILFKGIPLESTDGERLVKSPQCSNPGLCVQPH HIGVSVKELDLYLAYFVHAAVISECQRQQLEAV SYSSRYALGLFYEAGTKIDVPWAGQYITSNPCI RFVSIDNKKRNIESSEIGPSLVIHTTVPFGVTYLE HSIEDVQELVFQQLENILPGLPQPIATKCQKW RHSQVTNAAANCPGQMTLHHKPFLACGGDG FTQSNFDGCITSALCVLEALKNYI | 2 | 5 |
| G17790.TCGA-06-5856-01A-01R-1849-01.4 | 1 | 386 | 211 | 319 | 8443 | MMLRGNLKQVRIEKNPARLRALESAVGESEP AAAAAMALALAGEPAPPAPAPPEDHPDEEM GFTIDIKSFLKPGEKTYTQRCRLFVGNLPTDITE EDFKRLFERYGEPSEVFINRDRGFGFIRLESRTL AEIAKAELDGTILKSRPLRIRFATHGAALTVKNL SPVVSNELLEQAFSQFGPVEKAVVVVDDRGR ATGKGFVEFAAKPPARKALERCGDGAFLLTTT PRPVIVEPMEQFDDEDGLPEKLMQKTQQYHK EREQPPRFAQPGTFEFEYASRWKALDEMEKQ QREQVDRNIREAKEKLEAEMEAARHEHQLML MRQDLMRRQEELRRLEELRNQELQKRKQIQL RHEEEHRRREEEMIRHREQEELRRQQEGFKP NYMENEGIVSPSDLDLVMSEGLGMRYAFIGP LETMHLNAEGMLSYCDRYSEGIKHVLQTFGPI PEFSRATAEKVNQDMCMKVPDDPEHLAARR QWRDECLMRLAKLKSQVQPQ | 6 | 6 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| GBM-CUMC3 338_L1 | 1 | 447 | 160 | 327 | 8444 | MKETIQGTGSWGPEPPGPGIPPAYSSPRRERL RWPPPPKPRLKSGGGFGPDPGSGTTVPARRL PVPRPSFDASASEEEEEEEEEEDEDEEEEVAA WRLPPRWSQLGTSQRPRPSRPTHRKTCSQRR RRAMRAFRMLLYSKSTSLTFHWKLWGRHRG RRRGLAHPKNHLSPQQGGATPQVPSPCCRFD SPRGPPPPRLGLLGALMAEDGVRGSPPVPSG PPMEEDGLRWTPKSPLDPDSGLLSCTLPNGF GGQSGPEGERSLAPPDASILISNVCSIGDHVA QELFQGSDLGMAEEAERPGEKAGQHSPLREE HVTCVQSILDEFLQTYGSLIPLSTDEVVKLEDI FQQEFSTPSRKGLVLQLIQSYQRMPGNAMVR GFRVAYKRHVLTMDDLGTLYGQNWLNDQV MNMYGDLVMDTVPEKVHFFNSFFYDKLRTK GYDGVKRWTKNTRHYVGSAAAFAGTPEHGQ FQGSPGGAYGTAQPPPHYGPTQPAYSPSQQL RAPSAFPAVQYLSQPQPQPYAVHGHFQPTQT GFLQPGGALSLQKQMEHANQQTGFSDSSSLR PMHPQALHPAPGLLASPQLPVQMQPAGKSG FAATSQPGPRLPFIQHSQNPRFYHK | 8 | 6 |
| G17790 .TCGA- 06- 5856- 01A- 01R- 1849- 01.4 | 1 | 37 | 228 | 497 | 8445 | MVNLAAMVWRRLLRKRWVLALVFGLSLVYFL SSTFKQDLDAGVSEHSGDWLDQDSVSDQFSV EFEVESLDSEDYSLSEEGQELSDEDDEVYQVTV YQAGESDTDSFEEDPEISLADYWKCTSCNEM NPPLPSHCNRCWALRENWLPEDKGKDKGEIS EKAKLENSTQAEEGFDVPDCKKTIVNDSRESC VEENDDKITQASQSQESEDYSQPSTSSSIIYSSQ EDVKEFEREETQDKEESVESSLPLNAIEPCVICQ GRPKNGCIVHGKTGHLMACFTCAKKLKKRNK PCPVCRQPIQMIVLTYFP | 1 | 9 |
| G17802 .TCGA- 28- 5208- 01A- 01R- 1850- 01.4 | 1 | 344 | 240 | 432 | 8446 | MDAPRASAAKPPTGRKMKARAPPPPGKAAT LHVHSDQKPPHDGALGSQQNLVRMKEALRA STMDVTVVLPSGLEKRSVLNGSHAMMDLLVE LCLQNHLNPSHHALEIRSSETQQPLSFKPNTLI GTLNVHTVFLKEKVPEEKVKPGPPKVPEKSVRL VVNYLRTQKAVVRVSPEVPLQNILPVICAKCEV SPEHVVLLRDNIAGEELELSKSLNELGIKELYA WDNRRETFRKSSLGNDETDKEKKKFLGFFKVN KRSNSKAEQLVLSGADSDEDTSRAAPGRGLN GCLTTPNSPSMHSRSLTLGPSLSLSGSISGVSVK SEMKKRRAPPPPGSGPPVQDKASEKGLLPFA VVGSTDEVKVGKRMVRGRHYPWGVLQVEN ENHCDFVKLRDMLLCTNMENLKEKTHTQHYE CYRYQKLQKMGFTDVGPNNQPVSFQEIFEAK RQEFYDQCQREEEELKQRFMQRVKEKEATFK EAEKELQDKFEHLKMIQQEEIRKLEEEKKQLEG EIIDFYKMKAASEALQTQLSTDTKKDKHRKK | 7 | 7 |
| G17210 .TCGA- 12- 0616- 01A- 01R- | 1 | 149 | 141 | 188 | 8447 | MKLALLLPWACCCLCGSALATGFLYPFSAAAL QQHGYPEPGAGSPGSGYASRRHWCHHTVTR TVSCQVQNGSETVVQRVYQSCRWPGPCANL VSYRTLIRPTYRVSYRTVTVLEWRCCPGFTGSN CDEECMNCTRLSDMSERLTTLEAKIICMGAKE NGLPLEYQEKLKAIEPNDYTGKVSEEIEDIIKKG ETQTL | 4 | 4 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 1849-01.2 | | | | | | | | |
| NYU_B | 1 | 89 | 380 | 1104 | 8448 | MAAETQTLNFGPEWLRALSSGGSITSPPLSPA LPKYKLADYRYGREEMLALFLKDNKIPSDLLDK EFLPILQEEPLPPLALVPFTEEEQLKEILECSHLLT VIKMEEAGDEIVSNAISYALYKAFSTSEQDKDN WNGQLKLLLEWNQLDLANDEIFTNDRRWES ADLQEVMFTALIKDRPKFVRLFLENGLNLRKFL THDVLTELFSNHFSTLVYRNLQIAKNSYNDALL TFVWKLVANFRRGFRKEDRNGRDEMDIELHD VSPITRHPLQALFIWAILQNKKELSKVIWEQTR GCTLAALGASKLLKTLAKVKNDINAAGESEELA NEYETRAVELFTECYSSDEDLAEQLLVYSCEAW GGSNCLELAVEATDQHFIAQPGVQNFLSKQW YGEISRDTKNWKIILCLFIIPLVGCGFVSFRKKPV DKHKKLLWYYVAFFTSPFVVFSWNVVFYIAFLL LFAYVLLMDFHSVPHPPELVLYSLVFVLFCDEV RQWYVNGVNYFTDLWNVMDTLGLFYFIAGI VFRLHSSNKSSLYSGRVIFCLDYIIFTLRLIHIFTV SRNLGPKIIMLQRMLIDVFFFLFLFAVWMVAF GVARQGILRQNEQRWRWIFRSVIYEPYLAMF GQVPSDVDGTTYDFAHCTFTGNESKPLCVELD EHNLPRFPEWITIPLVCIYMLSTNILLVNLLVA MFGYTVGTVQENNDQVWKFQRYFLVQEYCS RLNIPFPFIVFAYFYMVVKKCFKCCCKEKNMES SVCCFKNEDNETLAWEGVMKENYLVKINTKA NDTSEEMRHRFRQLDTKLNDLKGLLKEIANKI K | 4 | 10 |
| G17469 .TCGA-06-2557-01A-01R-1849-01.2 | 1 | 982 | 373 | 432 | 8449 | MRPSGTAGAALLALLAALCPASRALEEKKVCQ GTSNKLTQLGTFEDHFLSLQRMFNNCEVVLG NLEITYVQRNYDLSFLKTIQEVAGYVLIALNTVE RIPLENLQIIRGNMYYENSYALAVLSNYDANKT GLKELPMRNLQEILHGAVRFSNNPALCNVESI QWRDIVSSDFLSNMSMDFQNHLGSCQKCDP SCPNGSCWGAGEENCQKLTKIICAQQCSGRC RGKSPSDCCHNQCAAGCTGPRESDCLVCRKF RDEATCKDTCPPLMLYNPTTYQMDVNPEGKY SFGATCVKKCPRNYVVTDHGSCVRACGADSY EMEEDGVRKCKKCEGPCRKVCNGIGIGEFKDS LSINATNIKHFKNCTSISGDLHILPVAFRGDSFT HTPPLDPQELDILKTVKEITGFLLIQAWPENRT DLHAFENLEIIRGRTKQHGQFSLAVVSLNITSL GLRSLKEISDGDVIISGNKNLCYANTINWKKLF GTSGQKTKIISNRGENSCKATGQVCHALCSPE GCWGPEPRDCVSCRNVSRGRECVDKCNLLEG EPREFVENSECIQCHPECLPQAMNITCTGRGP DNCIQCAHYIDGPHCVKTCPAGVMGENNTLV WKYADAGHVCHLCHPNCTYGCTGPGLEGCP TNGPKIPSIATGMVGALLLLLVVALGIGLFMRR RHIVRKRTLRRLLQERELVEPLTPSGEAPNQAL LRILKETEFKKIKVLGSGAFGTVYKGLWIPEGEK VKIPVAIKELREATSPKANKEILDEAYVMASVD NPHVCRLLGICLTSTVQLITQLMPFGCLLDYVR EHKDNIGSQYLLNWCVQIAKGMNYLEDRRLV | 24 | 10 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | HRDLAARNVLVKTPQHVKITDFGLAKLLGAEE KEYHAEGGKVPIKWMALESILHRIYTHQSDV WSYGVTVWELMTFGSKPYDGIPASEISSILEK GERLPQPPICTIDVYMIMVKCWMIDADSRPK FRELIIEFSKMARDPQRYLVIQLQDKFEHLKMI QQEEIRKLEEEKKQLEGEIIDFYKMKAASEALQ TQLSTDTKKDKHRKK | | |
| G17480 .TCGA-27-1830-01A-01R-1850-01.2 | 1 | 471 | 331 | 737 | 8450 | MITSAAGIISLLDEDEPQLKEFALHKLNAVVND FWAEISESVDKIEVLYEDEGFRSRQFAALVASK VFYHLGAFEESLNYALGAGDLFNVNDNSEYVE TIIAKCIDHYTKQCVENADLPEGEKKPIDQRLE GIVNKMFQRCLDDHKYKQAIGIALETRRLDVF EKTILESNDVPGMLAYSLKLCMSLMQNKQFR NKVLRVLVKIYMNLEKPDFINVCQCLIFLDDPQ AVSDILEKLVKEDNLLMAYQICFDLYESASQQF LSSVIQNLRTVGTPIASVPGSTNTGTVPGSEKD SDSMETEEKTSSAFVGKTPEASPEPKDQTLKM IKILSGEMAIELHLQFLIRNNNTDLMILKNTKD AVRNSVCHTATVIANSFMHCGTTSDQFLRDN LEWLARATNWAKFTATASLGVIHKGHEKEAL QLMATYLPKDTSPGSAYQEGGGLYALGLIHA NHGGDIIDYLLNQLKNASNDATFSCTCEEQYV GTFCEEYDACQRKPCQNNASCIDANEKQDGS NFTCVCLPGYTGELCQSKIDYCILDPCRNGATC ISSLSGFTCQCPEGYFGSACEEKVDPCASSPCQ NNGTCYVDGVHFTCNCSPGFTGPTCAQLIDF CALSPCAHGTCRSVGTSYKCLCDPGYHGLYCE EEYNECLSAPCLNAATCRDLVNGYECVCLAEY KGTHCELYKDPCANVSCLNGATCDSDGLNGT CICAPGFTGEECDIDINECDSNPCHHGGSCLD QPNGYNCHCPHGWVGANCEIHLQWKSGH MAESLTNMPRHSLYIIIGALCVAFILMLIILIVGI CRISRIEYQGSSRPAYEEFYNCRSIDSEFSNAIAS IRHARFGKKSRPAMYDVSPIAYEDYSPDDKPL VTLIKTKDL | 12 | 6 |
| G17634 .TCGA-19-2625-01A-01R-1850-01.2 | 1 | 62 | 2 | 132 | 8451 | MAEGAQPHQPPQLGPGAAARGMKRESELEL PVPGAGGDGADPGLSKRPRTEEAAADGGGG MQGELEVKNMDMKPGSTLKITGSIADGTDGF VINLGQGTDKLNLHFNPRFSESTIVCNSLDGSN WGQEQREDHLCFSPGSEVKFTVTFESDKFKVK LPDGHELTFPNRLGHSHLSYLSVRGGFNMSSF KLKE | 1 | 2 |
| G17654 .TCGA-41-4097-01A-01R-1850-01.2 | 1 | 151 | 467 | 758 | 8452 | MDRPGFVAALVAGGVAGVSVDLILFPLDTIKT RLQSPQGFSKAGGFHGIYAGVPSAAIGSFPNA AAFFITYEYVKWFLHADSSSYLTPMKHMLAAS AGEVVACLIRVPSEVVKQRAQVSASTRTFQIFS NILYEEGIQGLYRGYKSTVLREIEEVRDAMENE MRTQLRRQAAAHTDHLRDVLRVQEQELKSEF EQNLSEKLSEQELQFRRLSQEQVDNFTLDINT AYARLRGIEQAVQSHAVAEEEARKAHQLWLS VEALKYSMKTSSAETPTIPLGSAVEAIKANCSD NEFTQALTAAIPPESLTRGVYSEETLRARFYAV QKLARRVAMIDETRNSLYQYFLSYLQSLLLFPP | 6 | 13 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | QQLKPPPELCPEDINTFKLLSYASYCIEHGDLEL AAKFVNQLKGESRRVAQDWLKEARMTLETK QIVEILTAYASAVGIGTTQVQPE | | |
| G17485 .TCGA-14-1402-02A-01R-2005-01.2 | 1 | 25 | 118 | 369 | 8453 | MGVPKFYRWISERYPCLSEVVKEHQVICNSFTI CNAEMQEVGVGLYPSISLLNHSCDPNCSIVFN GPHLLLRAVRDIEVGEELTICYLDMLMTSEERR KQLRDQYCFECDCFRCQTQDKDADMLTGDE QVWKEVQESLKKIEELKAHWKWEQVLAMCQ AIISSNSERLPDINIYQLKVLDCAMDACINLGLL EEALFYGTRTMEPYRIFFPGSHPVRGVQVMK VGKLQLHQGMFPQAMKNLRLAFDIMRVTHG REHSLIEDLILLLEECDANIRAS | 1 | 6 |
| G17498 .TCGA-02-2483-01A-01R-1849-01.2 | 1 | 338 | 85 | 225 | 8454 | MAAAGARLSPGPGSGLRGRPRLCFHPGPPPL LPLLLLFLLLLPPPPLLAGATAAASREPDSPCRLK TVTVSTLPALRESDIGWSGARAGAGAGTGAG AAAAAASPGSPGSAGTAAESRLLLFVRNELPG RIAVQDDLDNTELPFFTLEMSGTAADISLVHW RQQWLENGTLYFHVSMSSSGQLAQATAPTL QEPSEIVEEQMHILHISVMGGLIALLLLLLVFTV ALYAQRRWQKRRRIPQKSASTEATHEIHYIPS VLLGPQARESFRSSRLQTHNSVIGVPIRETPILD DYDCEEDEEPPRRANHVSREDEFGSQVTHTL DSLGHPGEEKVDFEKKDPSLPNVQVTRLTLLSE QAPGPVVMDLTGDLAVLKDQVFVLKEGVDY RVKISFKVHREIVSGLKCLHHTYRRGLRVDKTV YMVGSYGPSAQEYEFVTPVEEAPRGALVRGP YLVVSLFTDDDRTHHLSWEWGLCICQDWKD | 3 | 3 |
| G17799 .TCGA-06-1804-01A-01R-1849-01.4 | 1 | 613 | 256 | 282 | 8455 | MLRLQMTDGHISCTAVEFSYMSKISLNTPPGT KVKLSGIVDIKNGFLLLNDSNTTVLGGEVEHLIE KWELQRSLSKHNRSNIGTEGGPPPFVPFGQK CVSHVQVDSRELDRRKTLQVTMPVKPTNDN DEFEKQRTAAIAEVAKSKETKTFGGGGGGARS NLNMNAAGNRNREVLQKEKSTKSEGKHEGV YRELVDEKALKHITEMGFSKEASRQALMDNG NNLEAALNVLLTSNKQKPVMGPPLRGRGKGR GRIRSEDEEDLGNARPSAPSTLFDFLESKMGTL NVEEPKSQPQQLHQGQYRSSNTEQNGVKDN NHLRHPPRNDTRQPRNEKPPRFQRDSQNSKS VLEGSGLPRNRGSERPSTSSVSEVWAEDRIKC DRPYSRYDRTKDTSYPLGSQHSDGAFKKRDNS MQSRSGKGPSFAEAKENPLPQGSVDYNNQK RGKRESQTSIPDYFYDRKSQTINNEAFSGIKIEK HFNVNTDYQNPVRSNSFIGVPNGEVEMPLKG RRIGPIKPAGPVTAVPCDDKIFYNSGPKRRSGP IKPEKILESSIPMEYAKMWKPGDECFALYWED NKFYRAEVEALHSSGMTAVVKFIDYGNYEEVL LSNIKPIQTEAWGYDHSYYFIATFITDHIRHHA KYLNA | 12 | 10 |
| G17660 .TCGA-06-5414-01A-01R- | 1 | 555 | 34 | 526 | 8456 | MADPGMMSLFGEDGNIFSEGLEGLGECGYPE NPVNPMGQQMPIDQGFASLQPSLHHPSTNQ NQTKLTHFDHYNQYEQQKMHLMDQPNRM MSNTPGNGLASPHSQYHTPPVPQVPHGGSG GGQMGVYPGMQNERHGQSFVDSSSMWGP RAVQVPDQIRAPYQQQQPQPQPPQPAPSGP | 2 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| 1849-01.2 | | | | | | PAQGHPQHMQQMGSYMARGDFSMQQHG QPQQRMSQFSQGQEGLNQGNPFIATSGPGH LSHVPQQSPSMAPSLRHSVQQFHHHPSTALH GESVAHSPRFSPNPPQQGAVRPQTLNFSSRS QTVPSPTINNSGQYSRYPYSNLNQGLVNNTG MNQNLGLTNNTPMNQSVPRYPNAVGFPSNS GQGLMHQQPIHPSGSLNQMNTQTMHPSQP QGTYASPPPMSPMKAMSNPAGTPPPQVRP GSAGIPMEVGSYPNMPHPQPSHQPPGAMGI GQRNMGPRNMQQSRPFIGMSSAPRELTGH MRPNGCPGVGLGDPQAIQERLIPGQQHPGQ QPSFQQLPTCPPLQPHPGLHHQSSPPHPHHQ PWAQLHPSPQNTPQKVPVHQFDGENMYMS MTEPSQDYVPASQSYPGPSLESEDFNIPPITPP SLPDHSLVHLNEVESGYHSLCHPMNHNGLLPF HPQNMDLPEITVSNMLGQDGTLLSNSISVMP DIRNPEGTQYSSHPQMAAMRPRGQPADIRQ QPGMMPHGQLTTINQSQLSAQLGLNMGGS NVPHNSPSPPGSKSATPSPSSSVHEDEGDDTS KINGGEKRPASDMGKKPKTPKKKKKKDPNEP QKPVSAYALFFRDTQAAIKGQNPNATFGEVSK IVASMWDGLGEEQKQVYKKKTEAAKKEYLKQ LAAYRASLVSKSYSEPVDVKTSQPPQLINSKPS VFHGPSQAHSALYLSSHYHQQPGMNPHLTA MHPSLPRNIAPKPNNQMPVTVSIANMAVSP PPPLQISPPLHQHLNMQQHQPLTMQQPLGN QLPMQVQSALHSPTMQQGFTLQPDYQTIINP TSTAAQVVTQAMEYVRSGCRNPPPQPVDW NNDYCSSGGMQRDKALYLT | | |
| GBM-CUMC3 296_L1 | 1 | 163 | 627 | 1210 | 8457 | MASASYHISNLLEKMTSSDKDFRFMATNDLM TELQKDSIKLDDDSERKVVKMILKLLEDKNGEV QNLAVKCLGPLVSKVKEYQVETIVDTLCTNML SDKEQLRDISSIGLKTVIGELPPASSGSALAANV CKKITGRLTSAIAKQEDVSVQLEALDIMADML SRCTGPGLEGCPTNGPKIPSIATGMVGALLLLL VVALGIGLFMRRRHIVRKRTLRRLLQERELVEP LTPSGEAPNQALLRILKETEFKKIKVLGSGAFGT VYKGLWIPEGEKVKIPVAIKELREATSPKANKEI LDEAYVMASVDNPHVCRLLGICLTSTVQLITQL MPFGCLLDYVREHKDNIGSQYLLNWCVQIAK GMNYLEDRRLVHRDLAARNVLVKTPQHVKIT DFGLAKLLGAEEKEYHAEGGKVPIKWMALESI LHRIYTHQSDVWSYGVTVWELMTFGSKPYD GIPASEISSILEKGERLPQPPICTIDVYMIMVKC WMIDADSRPKFRELIIEFSKMARDPQRYLVIQ GDERMHLPSPTDSNFYRALMDEEDMDDVVD ADEYLIPQQGFFSSPSTSRTPLLSSLSATSNNST VACIDRNGLQSCPIKEDSFLQRYSSDPTGALTE DSIDDTFLPVPEYINQSVPKRPAGSVQNPVYH NQPLNPAPSRDPHYQDPHSTAVGNPEYLNTV QPTCVNSTFDSPAHWAQKGSHQISLDNPDY QQDFFPKEAKPNGIFKGSTAENAEYLRVAPQS SEFIGA | 4 | 16 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17505.TCGA-06-2564-01A-01R-1849-01.2 | 1 | 40 | 525 | 1132 | 8458 | MNNLNDPPNWNIRPNSRADGGDGSRWNYALLVPMLGLAAFRVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD | 2 | 3 |
| G17798.TCGA-32-5222-01A-01R-1850-01.4 | 1 | 280 | 15 | 1673 | 8459 | MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGESVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGS | 6 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | STIYGHQLVSGDSTALSQSEDGARAPFTQAE MCLPCCSPQQGSLQLSSSEGGASTMAYMHV AEVVSAASAQGTLGMLQQSGRVFMVTDYSP EWSYPEGGVKVLITGPWQEASNNYSCLFDQIS VPASLIQPGVLRCYCPAHDTGLVTLQVAFNNQ IISNSVVFEYKARALPTLPSSQHDWLSLDDNQF RMSILERLEQMERRMAEMTGSQQHKQASG GGSSGGGSGSGNGGSQAQCASGTGALGSCF ESRVVVVCEKMMSRACWAKSKHLIHSKTFRG MTLLHLAAAQGYATLIQTLIKWRTKHADSIDL ELEVDPLNVDHFSCTPLMWACALGHLEAAVV LYKWDRRAISIPDSLGRLPLGIARSRGHVKLAE CLEHLQRDEQAQLGQNPRIHCPASEEPSTES WMAQWHSEAISSPEIPKGVTVIASTNPELRRP RSEPSNYYSSESHKDYPAPKKHKLNPEYFQTR QEKLLPTALSLEEPNIRKQSPSSKQSVPETLSPS EGVRDFSRELSPPTPETAAFQASGSQPVGKW NSKDLYIGVSTVQVTGNPKGTSVGKEAAPSQ VRPREPMSVLMMANREVVNTELGSYRDSAE NEECGQPMDDIQVNMMTLAEHIIEATPDRIK QENFVPMESSGLERTDPATISSTMSWLASYLA DADCLPSAAQIRSAYNEPLTPSSNTSLSPVGSP VSEIAFEKPNLPSAADWSEFLSASTSEKVENEF AQLTLSDHEQRELYEAARLVQTAFRKYKGRPL REQQEVAAAVIQRCYRKYKQYALYKKMTQAA ILIQSKFRSYYEQKKFQQSRRAAVLIQKYYRSYK KCGKRRQARRTAVIVQQKLRSSLLTKKQDQA ARKIMRFLRRCRHSPLVDHRLYKRSERIEKGQ GT | | |
| GBM-CUMC3 297_L1 | 1 | 57 | 358 | 372 | 8460 | MARGYGATVSLVLLGLGLALAVIVLAVVLSRH QAPCGPQAFAHAAVAADSKVCSDIGRQETAY LLVYMKMEC | 1 | 10 |
| GBM-CUMC3 342_L1 | 1 | 169 | 341 | 484 | 8461 | MFVYVLTPGEQSGRRLPGQTWLMFSCFCFSL QDNSFSSTTVTECDEDPVSLHEDQTDCSSLRD ENNKENYPDAGALVEEHAPPSWEPQQQNVE ATVLVDSVLRPSMGNFKSRKPKSIFKAESGRS HGESQETEHVVSSQSECQVRAGTPAHESPQN NAFKCQETVRLQPRSRKDSLESDSSTAIIPHELI RTRQLESVHLKFNQESGALIPLCLRGRLLHGRH FTYKSITGDMAITFVSTGVEGAFATEEHPYAA HGPWLQILLTEEFVEKMLEDLEDLTSPEEFKLP KEYSWPEKKLKVSILPDVVFDSPLH | 4 | 9 |
| G17500 .TCGA-27-1831-01A-01R-1850-01.2 | 1 | 2661 | 303 | 468 | 8462 | MHSAGTPGLSSRRTGNSTSFQPGPPPPPRLLL LLLLLSLVSRVPAQPAAFGRALLSPGLAGAAG VPAEEAIVLANRGLRVPFGREVWLDPLHDLVL QVQPGDRCAVSVLDNDALAQRPGRLSPKRFP CDFGPGEVRYSHLGARSPSRDRVRLQLRYDAP GGAVVLPLVLEVEVVFTQLEVVTRNLPLVVEEL LGTSNALDARSLEFAFQPETEECRVGILSGLGA LPRYGELLHYPQVPGGAREGGAPETLLMDCK AFQELGVRYRHTAASRSPNRDWIPMVVELRS RGAPVGSPALKREHFQVLVRIRGGAENTAPKP SFVAMMMMEVDQFVLTALTPDMLAAEDAE SPSDLLIFNLTSPFQPGQGYLVSTDDRSLPLSSF | 16 | 7 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | TQRDLRLLKIAYQPPSEDSDQERLFELELEVVD LEGAASDPFAFMVVVKPMNTMAPVVTRNTG LILYEGQSRPLTGPAGSGPQNLVISDEDDLEAV RLEVVAGLRHGHLVILGASSGSSAPKSFTVAEL AAGQVVYQHDDRDGSLSDNLVLRMVDGGG RHQVQFLFPITLVPVDDQPPVLNANTGLTLAE GETVPILPLSLSATDMDSDDSLLLFVLESPFLTT GHLLLRQTHPPHEKQELLRGLWRKEGAFYERT VTEWQQQDITEGRLFYRHSGPHSPGPVTDQF TFRVQDNHDPPNQSGLQRFVIRIHPVDRLPPE LGSGCPLRMVVQESQLTPLRKKWLRYTDLDT DDRELRYTVTQSPTDTDENHLPAPLGTLVLTD NPSVVVTHFTQAQINHHKIAYRPPGQELGVA TRVAQFQFQVEDRAGNVAPGTFTLYLHPVDN QPPEILNTGFTIQEKGHHILSETELHVNDVDTD VAHISFTLTQAPKHGHMRVSGQILHVGGLFHL EDIKQGRVSYAHNGDKSLTDSCSLEVSDRHHV VPITLRVNVRPVDDEVPILSHPTGTLESYLDVLE NGATEITANVIKGTNEETDDLMLTFLLEDPPLY GEILVNGIPAEQFTQRDILEGSVVYTHTSGEIGL LPKADSFNLSLSDMSQEWRIGGNTIQGVTIW VTILPVDSQAPEIFVGEQLIVMEGDKSVITSVHI SAEDVDSLNDDILCTIVIQPTSGYVENISPAPGS EKSRAGIAISAFNLKDLRQGHINYVQSVHKGV EPVEDRFVFRCSDGINFSERQFFPIVIIPTNDEQ PEMFMREFMVMEGMSLVIDTPILNAADADV PLDDLTFTITQFPTHGHIMNQLINGTVLVESFT LDQIIESSSIIYEHDDSETQEDSFVIKLTDGKHSV EKTVLIIVIPVDDETPRMTINNGLEIEIGDTKIIN NKILMATDLDSEDKSLVYIIRYGPGHGLLQRRK PTGAFENITLGMNFTQDEVDRNLIQYVHLGQ EGIRDLIKFDVTDGINPLIDRYFYVSIGSIDIVFP DVISKGVSLKEGGKVTLTTDLLSTSDLNSPDEN LVFTITRAPMRGHLECTDQPGVSITSFTQLQLA GNKIYYIHTADDEVKMDSFEFQVTDGRNPVF RTFRISISDVDNKKPVVTIHKLVVSESENKLITPF ELTVEDRDTPDKLLKFTITQVPIHGHLLFNNTR PVMVFTKQDLNENLISYKHDGTESSEDSFSFT VTDGTHTDFYVFPDTVFETRRPQVMKIQVLA VDNSVPQIAVNKGASTLRTLATGHLGFMITSKI LKVEDRDSLHISLRFIVTEAPQHGYLLNLDKGN HSITQFTQADIDDMKICYVLREGANATSDMFY FAVEDGGGNKLTYQNFRLNWAWISFEKEYYL VNEDSKFLDVVLKRRGYLGETSFISIGTRDRTA EKDKDFKGKAQKQVQFNPGQTRATWRVRILS DGEHEQSETFQVVLSEPVLAALEFPTVATVEIV DPGDEPTVFIPQSKYSVEEDVGELFIPIRRSGD VSQELMVVCYTQQGTATGTVPTSVLSYSDYIS RPEDHTSVVRFDKDEREKLCRIVIIDDSLYEEEE TFHVLLSMPMGGRIGSEFPGAQVTIVPDKDD EPIFYFGDVEYSVDESAGYVEVQVWRTGTDLS KSSSVTVRSRKTDPPSADAGTDYVGISRNLDF APGVNMQPVRVVILDDLGQPALEGIEKFELVL RMPMNAALGEPSKATVSINDSVSDLPKMQFK | | |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | ERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEHGETYPYQYSLSIRGSTTLRFYRNLNLEACLWEFVSYYDMSELLADCGGTIGTDGQVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKAQSHSTGGSRDPAHSTFLSLDSVRSPGILIMTSSVRNFYVVGRAWIS | | |
| G17212.TCGA-06-0129-01A-01R-1849-01.2 | 1 | 304 | 415 | 655 | 8463 | MAIDRRREAAGGGPGRQPAPAEENGSLPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL | 3 | 4 |
| GBM-CUMC3322_L1 | 1 | 4 | 641 | 1066 | 8464 | MENTDRKVSSLHTSRVQRQMVVSVHDLPEKSFVPLLDSKYVLCVWDIWQPSGPQKVLICESQVTCCCLSPLKAFLLFAGTAHGSVVVWDLREDSRLHYSVTLSDGFWTFRTATFSTDGILTSVNHRSPLQAVEPISTSVHKKQSFVLSPFSTQEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK | 2 | 16 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17675 .TCGA-19-2624-01A-01R-1850-01.2 | 1 | 250 | 13 | 204 | 8465 | MTCPRNVTPNSYAEPLAAPGGGERYSRSAG MYMQSGSDFNCGVMRGCGLAPSLSKRDEGS SPSLALNTYPSYLSQLDSWGDPKAAYRLEQPV GRPLSSCSYPPSVKEENVCCMYSAEKRAKSGP EAALYSHPLPESCLGEHEVPVPSYYRASPSYSA LDKTPHCSGANDFEAPFEQRASLNPRAEHLES PQLGGKVSFPETPKSDSQTPSPNEIKTEQSLAG PKGSPSESEKERAKAADSSPDTSDNEAKGKYIA STQRPDGTWRKQRRVKEGYVPQEEVPVYEN KYVKFFKSKPELPPGLSPEATAPVTPSRPEGGE PGLSKTAKRNLKRKEKRRQQQEKGEAEALSRT LDKVSLEETAQLPSAPQGSRAAPTAASDQPDS AATTEKAKKIKNLKKKLRQVEELQQRIQAGEVS QPSKEQLEKLARRRALEEELEDLELGL | 1 | 2 |
| G17803 .TCGA-76-4925-01A-01R-1850-01.4 | 1 | 359 | 14 | 425 | 8466 | MAAEKQVPGGGGGGGSGGGGGSGGGGSG GGRGAGGEENKENERPSAGSKANKEFGDSLS LEILQIIKESQQQHGLRHGDFQRYRGYCSRRQ RRLRKTLNFKMGNRHKFTGKKVTEELLTDNRY LLLVLMDAERAWSYAMQLKQEANTEPRKRF HLLSRLRKAVKHAEELERLCESNRVDAKTKLEA QAYTAYLSGMLRFEHQEWKAAIEAFNKCKTIY EKLASAFTEEQAVLYNQRVEEISPNIRYCAYNI GDQSAINELMQMRLRSGGTEGLLAEKLEALIT QTRAKQAATMSEVEWRGRTVPVKIDKVRIFLL GLADNEAAIVQAESEETKERLFESMLSECRDAI QVVREELKPDQPLISRNYKGDVAMSKIEHFM PLLVQREEEGALAPLLSHGQVHFLWIKHSNLY LVATTSKNANASLVYSFLYKTIEVFCEYFKELEE ESIRDNFVIVYELLDELMDFGFPQTTDSKILQEY ITQQSNKLETGKSRVPPTVTNAVSWRSEGIKY KKNEVFIDVIESVNLLVNANGSVLLSEIVGTIKL KVFLSGMPELRLGLNDRVLFELTGLSGSKNKS VELEDVKFHQCVRLSRFDNDRTISFIPPDGDFE LMSYRLSTQVKPLIWIESVIEKFSHSRVEIMVK AKGQFKKQSVANGVEISVPVPSDADSPRFKTS VGSAKYVPERNVVIWSIKSFPGGKEYLMRAHF GLPSVEKEEVEGRPPIGVKFEIPYFTVSGIQVRY MKIIEKSGYQALPWVRYITQSGDYQLRTS | 9 | 2 |
| G17796 .TCGA-41-5651-01A-01R-1850-01.4 | 1 | 211 | 100 | 350 | 8467 | MSLLRSLRVFLVARTGSYPAGSLLRQSPQPRH TFYAGPRLSASASSKELLMKLRRKTGYSFVNCK KALETCGGDLKQAEIWLHKEAQKEGWSKAAK LQGRKTKEGLIGLLQEGNTTVLVEVNCETDFV SRNLKFQLLVQQVALGTMMHCQTLKDQPSA YSKVQWLTPVNLALWEAEAGGSLEGFLNSSEL SGLPAGPDREGSLKDQLALAIDSTSAYSSLLTF HLSTPRSHHLYHARLWLHVLPTLPGTLCLRIFR WGPRRRQGSRTLLAEHHITNLGWHTLTLPS SGLRGEKSGVLKLQLDCRPLEGNSTVTGQPRR LLDTAGHQQPFLELKIRANEPGAGRARRRTPT CEPATPLCCRRDHYVDFQELGWRDWILQPEG YQLNYCSGQCPPHLAGSPGIAASFHSAVFSLLK ANNPWPASTSCCVPTARRPLSLLYLDHNGNV VKTDVPDMVVEACGCS | 6 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17663.TCGA-19-2619-01A-01R-1850-01.2 | 1 | 140 | 585 | 1374 | 8468 | MASLRRVKVLLVLNLIAVAGFVLFLAKCRPIAVRSGDAFHEIRPRAEVANLSAHSASPIQDAVLKRLSLLEDIVYRQLNGLSKSLGLIEGYGGRGKGGLPATLSPAEEEKAKGPHEKYGYNSYLSEKISLDRSIPDYRPTKFVIGREKPGQVSEVAQLISQTLEQERRQRELLEQHYAQYDADDDENTVAELQGMSGNCNNNNNYFLKTGEYATDEEEDEVGPVLPGSDMAIEVFELPENEDMFSPSELDTSKLSHFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKVENTWITKANKRNPNPSSSSIFGRHSQLMSVVWIQETNNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ | 2 | 5 |
| G17207.TCGA-06-0156-01A-03R-1849-01.2 | 1 | 2 | 205 | 925 | 8469 | MQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD | 1 | 8 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17802 .TCGA-28-5208-01A-01R-1850-01.4 | 1 | 68 | 190 | 225 | 8470 | MGETMSKRLKLHLGGEAEMEERAFVNPFPDY EAAAGALLASGAAEETGCVRPPATTDEPGLPF HQDGKDAFIGFGGNVIRQQVKDNAKWYITD FVELLGELEE | 1 | 6 |
| G17485 .TCGA-14-1402-02A-01R-2005-01.2 | 1 | 17 | 156 | 569 | 8471 | MPQSKSRKIAILGYRSVASGLSSSPSTPTQVTK QHTFPLESYKHEPERLENRIYASSSPPDTGQRF CPSSFQSPTRPPLASPTHYAPSKAAALAAALGP AEAGMLEKLEFEDEAVEDSESGVYMRFMRSH KCYDIVPTSSKLVVFDTTLQVKKAFFALVANGV RAAPLWESKKQSFVGMLTITDFINILHRYYKSP MVQIYELEEHKIETWRELYLQETFKPLVNISPD ASLFDAVYSLIKNKIHRLPVIDPISGNALYILTHK RILKFLQLFMSDMPKPAFMKQNLDELGIGTYH NIAFIHPDTPIIKALNIFVERRISALPVVDESGKV VDIYSKFDVINLAAEKTYNNLDITVTQALQHRS QYFEGVVKCNKLEILETIVDRIVRAEVHRLVVV NEADSIVGIISLSDILQALILTPAGAKQKETETE | 1 | 4 |
| NYU_E | 1 | 252 | 68 | 211 | 8472 | MGAGPSLLLAALLLLSGDGAVRCDTPANCTY LDLLGTWVFQVGSSGSQRDVNCSVMGPQEK KVVVYLQKLDTAYDDLGNSGHFTIIYNQGFEIV LNDYKWFAFFKYKEEGSKVTTYCNETMTGWV HDVLGRNWACFTGKKVGTASENVYVNIAHLK NSQEKYSNRLYKYDHNFVKAINAIQKSWTATT YMEYETLTLGDMIRRSGGHSRKIPRPKPAPLT AEIQQKILHLPTSWDWRNVHGINFVSPVRNQ GQERFGNMTRVYYREAMGAFIVFDVTRPATF EAVAKWKNDLDSKLSLPNGKPVSVVLLANKC DQGKDVLMNNGLKMDQFCKEHGFVGWFET SAKENINIDEASRCLVKHILANECDLMESIEPD VVKPHLTSTKVASCSGCAKS | 5 | 2 |
| G17212 .TCGA-06-0129-01A-01R-1849-01.2 | 1 | 1367 | 15 | 338 | 8473 | MAERGLEPSPAAVAALPPEVRAQLAELELELS EGDITQKGYEKKRSKLLSPYSPQTQETDSAVQ KELRNQTPAPSAAQTSAPSKYHRTRSGGARD ERYRSDIHTEAVQAALAKHKEQKMALPMPTK RRSTFVQSPADACTPPDTSSASEDEGSLRRQA ALSAALQQSLQNAESWINRSIQGSSTSSSASST LSHGEVKGTSGSLADVFANTRIENFSAPPDVT TTTSSSSSSSSIRPANIDLPPSGIVKGMHKGSN RSSLMDTADGVPVSSRVSTKIQQLLNTLKRPK RPPLKEFFVDDSEEIVEVPQPDPNQPKPEGRQ MTPVKGEPLGVICNWPPALESALQRWGTTQ AKCSCLTALDMTGKPVYTLTYGKLWSRSLKLA YTLLNKLGTKNEPVLKPGDRVALVYPNNDPV MFMVAFYGCLLAEVIPVPIEVPLTRKDAGGQ QJGFLLGSCGIALALTSEVCLKGLPKTQNGEIV QFKGWPRLKWVVTDSKYLSKPPKDWQPHISP AGTEPAYIEYKTSKEGSVMGVTVSRLAMLSHC QALSQACNYSEGETIVNVLDFKKDAGLWHG MFANVMNKMHTISVPYSVMKTCPLSWVQR VHAHKAKVALVKCRDLHWAMMAHRDQRD | 34 | 2 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| | | | | | | VSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMIESRSVTQAGVQWQDLGSLQPPPPGFKRFSSLSLLSSWNYRRILEPRRRTPLSCSRTPPCRVAGMGRRTSSITLICGR | | |
| G17787.TCGA-26-5139-01A-01R-1850-01.4 | 1 | 337 | 376 | 601 | 8474 | MEPPAAKRSRGCPAGPEERDAGAGAARGRGRPEALLDLSAKRVAESWAFEQVEERFSRVPEPVQKRIVFWSFPRSEREICMYSSLGYPPPEGEHDARVPFTRGLHLLQSGAVDRVLQVGFHLSGNIREPGSPGEPERLYHVSISFDRCKITSVSCGCDNRDLFYCAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGISRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS | 5 | 7 |

FIG. 27 Cont.

| sample | Protein Start 5p | Protein Stop 5p | Protein Start 3p | Protein Stop 3p | SEQ ID NO: | Protein Sequence | Exon Break 5p | Exon Break 3p |
|---|---|---|---|---|---|---|---|---|
| G17675 .TCGA-19-2624-01A-01R-1850-01.2 | 1 | 473 | 82 | 514 | 8475 | MDVLPTGGGRPGLRTELEFRGGGGEARLESQ EEETIPAAPPAPRLRGAAERPRRSRDTWDGDE DTEPGEACGGRTSRTASLVSGLLNELYSCTEEE EAAGGGRGAEGRRRRRDSLDSSTEASGSDVV LGGRSGAGDSRVLQELQERPSQRHQMLYLR QKDANELKTILRELKYRIGIQSAKLLRHLKQKDR LLHKVQRNCDIVTACLQAVSQKRRVDTKLKFT LEPSLGQNGFQQWYDALKAVARLSTGIPKEW RRKVWLTLADHYLHSIAIDWDKTMRFTFNER SNPDDDSMGIQIVKDLHRTGCSSYCGQEAEQ DRVVLKRVLLAYARWNKTVGYCQGFNILAALI LEVMEGNEGDALKIMIYLIDKVLPESYFVNNLR ALSVDMAVFRDLLRMKLPELSQHLDTLQRTA NKESGGGYEPPLTNVFTMQWFLTLFATCLPN QTVLKIWDSVFFEGSEIILRVSLAIWAKLGEVIN AGKSTHNEDQASCEVLTVKKKAGAVTSTPNR NSSKRRSSLPNGEGLQLKENSESEGVSCHYWS LFDGHAGSGAAVVASRLLQHHITEQLQDIVDI LKNSAVLPPTCLGEEPENTPANSRTLTRAASLR GGVGAPGSPSTPPTRFFTEKKIPHECLVIGALE SAFKEMDLQIERERSSYNISGGCTALIVICLLGK LYVANAGDSRAIIIRNGEIIPMSSEFTPETERQR LQYLAFMQPHLLGNEFTHLEFPRRVQRKELGK KMLYRDFNMTGWAYKTIEDEDLKFPLIYGEGK KARVMATIGVTRGLGDHDLKVHDSNIYIKPFL SSAPEVRIYDLSKYDHGSDDVLILATDGLWDVL SNEEVAEAITQFLPNCDPDDPHRYTLAAQDLV MRARGVLKDRGWRISNDRLGSGDDISVYVIPL IHGNKLS | 8 | 2 |
| G17800 .TCGA-06-5859-01A-01R-1849-01.4 | 1 | 318 | 97 | 104 | 8476 | MDNMSITNTPTSNDACLSIVHSLMCHRQGG ESETFAKRAIESLVKKLKEKKDELDSLITAITTNG AHPSKCVTIQRTLDGRLQVAGRKGFPHVIYAR LWRWPDLHKNELKHVKYCQYAFDLKCDSVCV NPYHYERVVSPGIDLSGLTLQSNAPSSMMVK DEYVHDFEGQPSLSTEGHSIQTIQHPPSNRAS TETYSTPALLAPSESNATSTANFPNIPVASTSQ PASILGGSHSEGLLQIASGPQPGQQQNGFTG QPATYHHNSTTTWTGSRTAPYTPNLPHHQN GHLQHHPPMPPHPGHYWPVHNELAFQPPIS NHPGVVPEPTG | 7 | 2 |
| G17638 .TCGA-28-2499-01A-01R-1850-01.2 | 1 | 116 | 70 | 211 | 8477 | MAAAAGAPPPGPPQPPPPPPPEESSDSEPEA EPGSPQKLIRKVSTSGQIRQKTIIKEGMLTKQN NSFQRSKRRYFKLRGRTLYYAKTAKSIIFDEVDL TDASVAESSTKNVNNSFTVEVLDENNLVMNL EFSIRETTCRKDSGEDPATCAFQRDYYVSTAVC RSTVKVSAQQVQGVHARCSWSSSTSESYSSEE MIFGDMLGSHKWRNNYLFGLISDESISEQFYD RSLGIMRRVLPPGNRRYPNHRHRARINTDFE | 3 | 3 |

FIG. 27 Cont.

| sample | split reads | gene5p | chr5p | Sense 5p | Start 5p | End 5p | Breakpoint 5p | Exon Before Break point 5p |
|---|---|---|---|---|---|---|---|---|
| TCGA-06-0750-01A-01D-1492-08 | 51 | EGFR | chr7 | + | 55054218 | 55268221 | 55268221 | 24 |
| TCGA-27-1837-01A-01D-1494-08 | 648 | EGFR | chr7 | + | 55086724 | 55268937 | 55268937 | 24 |
| TCGA-28-2513-01A-01D-1494-08 | 378 | EGFR | chr7 | + | 55086724 | 55269001 | 55269001 | 24 |
| TCGA-06-5411-01A-01D-1696-08 | 676 | NFASC | chr1 | + | 204797781 | 204951827 | 204951827 | 21 |
| TCGA-32-5222-01A-01D-1486-08 | 0 | EGFR | chr7 | + | 55086724 | N/A | N/A | N/A |
| TCGA-28-5209-01A-01D-1486-08 | 0 | EGFR | chr7 | + | 55086724 | N/A | N/A | N/A |

| sample | split reads | Gene 3p | chr3p | Sense 3p | start3p | end3p | Breakpoint 3p | Exon After Break point 3p |
|---|---|---|---|---|---|---|---|---|
| TCGA-06-0750-01A-01D-1492-08 | 51 | SEPT14 | chr7 | - | 55828730 | 55871487 | 55871487 | 10 |
| TCGA-27-1837-01A-01D-1494-08 | 648 | SEPT14 | chr7 | - | 55861236 | 55870909 | 55870909 | 10 |
| TCGA-28-2513-01A-01D-1494-08 | 378 | SEPT14 | chr7 | - | 55861236 | 55871369 | 55871369 | 10 |
| TCGA-06-5411-01A-01D-1696-08 | 676 | NTRK1 | chr1 | + | 156844170 | 156851642 | 156844170 | 10 |
| TCGA-32-5222-01A-01D-1486-08 | 0 | SEPT14 | chr7 | - | 55861236 | N/A | N/A | N/A |
| TCGA-28-5209-01A-01D-1486-08 | 0 | PSPH | chr7 | - | 56078743 | N/A | N/A | N/A |

Fig. 28

| sample | split inserts | posA5p | posB5p | Read Dir 5p | posA3p | posB3p | readDir 3p |
|---|---|---|---|---|---|---|---|
| TCGA-06-0750-01A-01D-1492-08 | 17 | 55242336 | 55268011 | Fwd | 55871183 | 55871412 | Fwd |
| TCGA-27-1837-01A-01D-1494-08 | 505 | 55268346 | 55268884 | Fwd | 55870367 | 55870871 | Fwd |
| TCGA-28-2513-01A-01D-1494-08 | 251 | 55268377 | 55268962 | Fwd | 55871008 | 55871339 | Fwd |
| TCGA-06-5411-01A-01D-1696-08 | 131 | 204951788 | 204951826 | Fwd | 156844171 | 156844232 | Rev |
| TCGA-32-5222-01A-01D-1486-08 | 1 | 55268015 | 55268015 | Fwd | 55872287 | 55872287 | Fwd |
| TCGA-28-5209-01A-01D-1486-08 | 1 | 55198162 | 55198162 | Rev | 56087184 | 56087184 | Fwd |

| gene | gene | gene | gene |
|---|---|---|---|
| ABCA13 | C21orf29 | CAMKK1 | DNAJC6 |
| ABCC1 | CACNA1C | CAMSAP1 | DYRK3 |
| ABCC12 | CACNA1G | CAMTA1 | EIF2C2 |
| ABCC6 | CNTNAP4 | CAP2 | FAM184B |
| ABL1 | CUL3 | CCDC147 | FREM2 |
| ADAM12 | DMD | CCDC158 | GDPD2 |
| ADCY10 | DUSP27 | CELF2 | GLI3 |
| ADCY2 | ECE1 | CILP | IL1RN |
| ADCY8 | EYS | CMYA5 | ISX |
| AGBL4 | FAM172A | COL14A1 | KIDINS220 |
| AHNAK | FAM184B | CORO7 | LRBA |
| ANXA7 | EGFR4 | CSMD2 | LY75 |
| AP4S1 | ITGAV | CUL3 | MDH2 |
| AQP2 | LRP1 | DDI2 | MMP12 |
| ARMC6 | LY75 | DEPDC5 | N4BP2L2 |
| ATP5B | MAPKAP1 | DEPDC7 | NCF2 |
| ATP6AP1L | MYT1 | DI10L | NCOR1 |
| ATP6V0D2 | NCF2 | DMD | NCRNA00157 |
| ATXN1 | NCOR1 | EDA | NRXN3 |
| BAHD1 | NHSL2 | EFHC1 | PARP16 |
| BBX | NKAIN2 | EFS | PLA2G2F |
| BCA10 | NR3C1 | EIF2C2 | PLEK2 |
| C15orf23 | NUP188 | ENTPD2 | PRKCH |
| C15orf33 | OSBPL10 | EYS | PTPRS |
| C21orf29 | PACSIN1 | FAM160A1 | ROBO1 |
| C2CD3 | PARP16 | MUSK | SASH3 |
| C6orf170 | PDZRN4 | NEUROG1 | SH3BP5 |
| C7orf44 | POLM | NHSL2 | SLC44A2 |
| CACNA1C | PPP1R3A | NR3C1 | SLC5A4 |
| CACNA1G | PSEN1 | ODZ1 | SNX5 |
| FAM168A | PTPRD | PCDH12 | SORCS2 |
| FAM172A | PTPRS | PLCL1 | SRRM1 |
| FAM192A | RALYL | PLEKHM3 | SSX3 |
| FAM19A2 | RERE | PLOD3 | STAG2 |
| FBXL4 | RIMBP2 | PRKCH | STK24 |
| FH | RNF216 | PSEN1 | SURF6 |
| FREM2 | SDAD1 | SEPT5 | SYNPO2 |
| GAPVD1 | SEC14L3 | SLC44A2 | TAF1 |
| GLI3 | SH3RF3 | SNTA1 | TMEM80 |
| GPR182 | SLC9A1 | USP48 | TNFRSF10B |
| GSTA3 | SMOC2 | VSNL1 | TTYH1 |
| IGFBP3 | SNX5 | WDFY1 | UNC93B1 |
| ITGA9 | TACC2 | WISP2 | VSNL1 |
| ITGB2 | SRGAP1 | XRRA1 | XRCC4 |
| JOSD2 | SSX3 | LRRC4B | ZNF410 |
| KIDINS220 | SUMF1 | LRRK2 | TRIOBP |
| LAMA2 | SYNPO2 | MAPKAP1 | TTYH1 |
| LCLAT1 | TNFRSF10B | MST1R | LRBA |
| LIN9 | | | |

| EGFR-SEPT14 | | | | |
|---|---|---|---|---|
| Sample | Fusion Bp | Exon25-26 | Exon26-27 | Exon27-28 |
| TCGA-28-2513 | 1464 | 21 | 12 | 25 |
| TCGA-27-1837 | 796 | 6 | 5 | 6 |
| TCGA-06-0750 | 414 | 69 | 61 | 101 |
| TCGA-32-5222 | 495 | 256 | 190 | 348 |
| TCGA-28-1747 | 142 | 426 | 300 | 502 |
| TCGA-06-2557 | 13 | 1031 | 657 | 1254 |

| EGFR-PSPH | | | | |
|---|---|---|---|---|
| Sample | Fusion Bp | Exon25-26 | Exon26-27 | Exon27-28 |
| TCGA-28-5209 | 5648 | 216 | 122 | 232 |
| TCGA-06-5408 | 37 | 232 | 200 | 292 |
| TCGA-28-5215 | 28 | 29 | 26 | 44 |

Fig. 30

| sample | split reads | Gene 5p | Chr 5p | Sense 5p | Start 5p | End 5p | Break-point 5p | Exon Before Break-point 5p |
|---|---|---|---|---|---|---|---|---|
| TCGA-06-0750-01A-01D-1492-08 | 51 | EGFR | chr7 | + | 55054218 | 55268221 | 55268221 | 24 |
| TCGA-27-1837-01A-01D-1494-08 | 648 | EGFR | chr7 | + | 55086724 | 55268937 | 55268937 | 24 |
| TCGA-28-2513-01A-01D-1494-08 | 378 | EGFR | chr7 | + | 55086724 | 55269001 | 55269001 | 24 |
| TCGA-06-5411-01A-01D-1696-08 | 676 | NFASC | chr1 | + | 204797781 | 204951827 | 204951827 | 21 |
| TCGA-32-5222-01A-01D-1486-08 | 0 | EGFR | chr7 | + | 55086724 | N/A | N/A | N/A |
| TCGA-28-5209-01A-01D-1486-08 | 0 | EGFR | chr7 | + | 55086724 | N/A | N/A | N/A |

Fig. 31

| sample | Gene 3p | Chr 3p | Sense 3p | Start 3p | End 3p | Break-point 3p | Exon After Break-point 3p |
|---|---|---|---|---|---|---|---|
| TCGA-06-0750-01A-01D-1492-08 | SEPT14 | chr7 | - | 55828730 | 55871487 | 55871487 | 10 |
| TCGA-27-1837-01A-01D-1494-08 | SEPT14 | chr7 | - | 55861236 | 55870909 | 55870909 | 10 |
| TCGA-28-2513-01A-01D-1494-08 | SEPT14 | chr7 | - | 55861236 | 55871369 | 55871369 | 10 |
| TCGA-06-5411-01A-01D-1696-08 | NTRK1 | chr1 | + | 156844170 | 156851642 | 156844170 | 10 |
| TCGA-32-5222-01A-01D-1486-08 | SEPT14 | chr7 | - | 55861236 | N/A | N/A | N/A |
| TCGA-28-5209-01A-01D-1486-08 | PSPH | chr7 | - | 56078743 | N/A | N/A | N/A |

| sample | split inserts | posA 5p | posB 5p | Read Dir 5p | posA 3p | posB 3p | Read Dir 3p |
|---|---|---|---|---|---|---|---|
| TCGA-06-0750-01A-01D-1492-08 | 17 | 55242336 | 55268011 | Fwd | 55871183 | 55871412 | Fwd |
| TCGA-27-1837-01A-01D-1494-08 | 505 | 55268346 | 55268884 | Fwd | 55870367 | 55870871 | Fwd |
| TCGA-28-2513-01A-01D-1494-08 | 251 | 55268377 | 55268962 | Fwd | 55871006 | 55871339 | Fwd |
| TCGA-06-5411-01A-01D-1696-08 | 131 | 204951788 | 204951826 | Fwd | 156844171 | 156844232 | Rev |
| TCGA-32-5222-01A-01D-1486-08 | 1 | 55268015 | 55268015 | Fwd | 55872287 | 55872287 | Fwd |
| TCGA-28-5209-01A-01D-1486-08 | 1 | 55198162 | 55198162 | Rev | 56087184 | 56087184 | Fwd |

Fig. 31 Cont.

| Isoform | EGFR-SEPT14 | EGFR-PSPH | Non-Fusion | Total |
|---|---|---|---|---|
| EGFRvIII | 1 | 1 | 14 | 16 |
| No EGFRvIII | 5 | 2 | 64 | 71 |
| Total | 6 | 3 | 78 | 87 |

Fig. 32

| | Classical | Mesenchymal | Proneural | Neural |
|---|---|---|---|---|
| EGFR Fusion | 3 | 5 | 1 | 0 |
| No Fusion | 37 | 47 | 38 | 0 |
| Total | 40 | 52 | 39 | 28 |

Fig. 33

| B-III Tubulin | Mouse | 1:400 | Promega |
|---|---|---|---|
| δ-Catenin | Guinea Pig | 1:500 | Acris |
| Fibronectin | Mouse | 1:1000 | BD-Pharmingen |
| Col5A1 | Rabbit | 1:200 | Santa Cruz Biotech |
| PSD-95 | Rabbit | 1:500 | Invitrogen |
| Smooth muscle actin | Mouse | 1:200 | Sigma |

Fig. 34

| | | | |
|---|---|---|---|
| Anti-Vinculin | Mouse | 1:400 | SIGMA |
| Anti-N-Cadherin | Mouse | 1:200 | BD-Pharmingen |
| Cyclin A | Rabbit | 1:500 | Santa Cruz Biotech |
| p27 | Mouse | 1:250 | BD Transduction |
| B-III Tubulin | Mouse | 1:400 | Promega |
| δ-Catenin | Guinea Pig | 1:500 | Acris |
| Fibronectin | Mouse | 1:1000 | BD-Pharmingen |
| p107 | Rabbit | 1:1000 | Santa Cruz Biotech |
| Nestin | Mouse | 1:500 | BD-Pharmingen |
| CD133 | Rabbit | 1:200 | Abcam |
| Sox2 | Rabbit | 1:500 | Cell Signaling |
| EGFR | Mouse | 1:1000 | Millipore |
| AKT | Rabbit | 1:1000 | Cell Signaling |
| pAKT-S473 | Rabbit | 1:1000 | Cell Signaling |
| ERK1/2 | Rabbit | 1:1000 | Cell Signaling |
| pERK1/2 | Rabbit | 1:1000 | Cell Signaling |
| STAT3 | Rabbit | 1:1000 | Santa Cruz Biotech |
| pSTAT3-Y705 | Rabbit | 1:1000 | Cell Signaling |
| LZTR1 | Rabbit | 1:1000 | Abcam |
| Cul3 | Rabbit | 1:1000 | Bethyl |

Fig. 35

| Primer | SEQ ID NO: | Sequence |
|---|---|---|
| hEGFR-RT-FW1 | 32 | 5'- GGGTGACTGTTTGGGAGTTGATG -3 |
| hSEP14-RT-REV1 | 33 | 5'- TGTTTGTCTTTCTTTGTATCGGTGC-3' |
| hEGFR-RT-FW1 | 87 | 5'-AGAGGTGACCACCAATCAGC-3' |
| hPSPH-RT-REV1 | 88 | 5'-CGTGTCCCACACAGAGACAG-3' |
| hNFASC-RT-FW1 | 36 | 5'- AGTTCCGTGTCATTGCCATCAAC-3' |
| hNTRK1-RT-REV1 | 37 | 5'- TGTTTCGTCCTTCTTCTCCACCG-3' |
| hCAND1-RT-FW1 | 38 | 5'- GGAAAAAATGACATCCAGCGAC-3' |
| hEGFR-RT-REV1 | 39 | 5'- TGGGTGTAAGAGGCTCCACAAG-3' |

Fig. 36

| Primer | SEQ ID NO: | Sequence |
|---|---|---|
| genomic EGFR-FW1 | 40 | 5'- GGATGATAGACGCAGATAGTCGCC-3' |
| genomic SEPT14-REV1 | 41 | 5'- TCCAGTTGTTTTTTCTCTTCCTCG-3' |
| genomic NFASC-FW1 | 12 | 5'- TCCGAGTCCAGGCTGAAAATG-3' |
| genomic NTRK1-REV1 | 89 | 5'- CTACTTCCTATCTCACCCCAAAAGG-3' |
| genomic CAND1-FW1 | 44 | 5'- GCAATAGCAAAACAGGAAGATGTC-3' |
| genomic EGFR-REV1 | 45 | 5'- GAACACTTACCCATTCGTTGG-3' |

Fig. 37

| Primer | SEQ ID NO: | Sequence |
|---|---|---|
| LZTR1 FW | 90 | 5'- TCCCACATCTCAGACAAGCA-3' |
| His-Tag REV | 91 | 5'- TCAATGGTGATGGTGATGATG-3' |
| GAPDH FW | 92 | 5'- GAAGGTGAAGGTCGGAGTCAAC-3' |
| GAPDH REV | 93 | 5'- CAGAGTTAAAAGCAGCCCTGGT-3' |

Fig. 38

FUSION PROTEINS AND METHODS THEREOF

The application is a continuation of PCT International Application No. PCT/US2014/026351 filed on Mar. 13, 2014, which claims the benefit of and priority to U.S. Provisional Patent Application No. 61/793,086, filed on Mar. 15, 2013, the content of which are hereby incorporated by reference in their entireties.

GOVERNMENT SUPPORT

This invention was made with government support under grant CA101644 awarded by the National Institutes of Health. The Government has certain rights in the invention.

All patents, patent applications and publications cited herein are hereby incorporated by reference in their entirety. The disclosures of these publications in their entireties are hereby incorporated by reference into this application.

This patent disclosure contains material that is subject to copyright protection. The copyright owner has no objection to the facsimile reproduction by anyone of the patent document or the patent disclosure as it appears in the U.S. Patent and Trademark Office patent file or records, but otherwise reserves any and all copyright rights.

SEQUENCE LISTING

The instant application contains a Sequence Listing which has been submitted electronically in ASCII format and is hereby incorporated by reference in its entirety. Said ASCII copy, created on Nov. 23, 2015, is named 19240.1034US2_SL.txt and is 2,208,530 bytes in size.

BACKGROUND OF THE INVENTION

Glioblastoma multiforme (GBM) is the most common form of brain cancer and among the most incurable and lethal of all human cancers. The current standard of care includes surgery, chemotherapy, and radiation therapy. However, the prognosis of GBM remains uniformly poor. There are few available targeted therapies and none that specifically target GBM.

The target population of GBM patients who may carry EGFR gene fusions and would benefit from targeted inhibition of EGFR kinase activity is estimated to correspond to 6,000 patients per year world-wide.

SUMMARY OF THE INVENTION

The invention is based, at least in part, on the discovery of a highly expressed class of gene fusions in GBM, which join the receptor tyrosine kinase (RTK) domain of EGFR genes to the coiled-coil domain of septin proteins, such as Septin-14, or fused to a polypeptide comprising a phosphoserine phosphatase (PSPH) protein or a polypeptide comprising a Cullin-associated and neddylation-dissociated (CAND) protein. The invention is based, at least in part, on the finding that EGFR-SEPT fusions, EGFR-PSPH fusions, and EGFR-CAND fusions identify a subset of GBM patients who will benefit from targeted inhibition of the tyrosine kinase activity of EGFR. Identification of fusions of EGFR genes in glioblastoma patients are useful therapeutic targets.

An aspect of the invention is directed to a purified fusion protein comprising a tyrosine kinase domain of an EGFR protein fused to a polypeptide that constitutively activates the tyrosine kinase domain of the EGFR protein. In one embodiment, the purified fusion protein is essentially free of other human proteins.

An aspect of the invention is directed to a purified fusion protein comprising the tyrosine kinase domain of an EGFR protein fused 5' to a polypeptide comprising the coiled-coil domain of a Septin protein. In one embodiment, the Septin protein is Septin-1, Septin-2, Septin-3, Septin-4, Septin-5, Septin-6, Septin-7, Septin-8, Septin-9, Septin-10, Septin-11, Septin-12, Septin-13, or Septin-14. In another embodiment, the Septin protein is Septin-14 (SEPT14). In another embodiment, the purified fusion protein is essentially free of other human proteins.

An aspect of the invention is directed to a purified fusion protein comprising the tyrosine kinase domain of an EGFR protein fused 5' to a polypeptide comprising a phosphoserine phosphatase (PSPH) protein. In another embodiment, the purified fusion protein is essentially free of other human proteins.

An aspect of the invention is directed to a purified fusion protein comprising the tyrosine kinase domain of an EGFR protein fused 3' to a polypeptide comprising a Cullin-associated and neddylation-dissociated (CAND) protein. In one embodiment, the CAND protein is CAND1, CAND2, or CAND3. In another embodiment, the purified fusion protein is essentially free of other human proteins.

An aspect of the invention is directed to a purified fusion protein encoded by an EGFR-SEPT14 nucleic acid, wherein EGFR-SEPT14 comprises a combination of exons 1-25 of EGFR located on human chromosome 7p11.2 spliced 5' to a combination of exons 7-10 of SEPT14 located on human chromosome 7, wherein a genomic breakpoint occurs in any one of exons 1-25 of EGFR and any one of exons 7-10 of SEPT14. In another embodiment, the purified fusion protein is essentially free of other human proteins.

An aspect of the invention is directed to a purified fusion protein encoded by an EGFR-PSPH nucleic acid, wherein EGFR-PSPH comprises a combination of exons 1-25 of EGFR located on human chromosome 7p12 spliced 5' to a combination of exons 1-10 of PSPH located on human chromosome 7p11.2, wherein a genomic breakpoint occurs in any one of exons 1-25 of EGFR and any one of exons 1-10 of PSPH. In another embodiment, the purified fusion protein is essentially free of other human proteins.

An aspect of the invention is directed to a purified fusion protein encoded by an EGFR-CAND1 nucleic acid, wherein EGFR-CAND1 comprises a combination of exons 1-25 of EGFR located on human chromosome 7p12 spliced 3' to a combination of exons 1-16 of CAND1 located on human chromosome 12q14, wherein a genomic breakpoint occurs in any one of exons 1-25 of EGFR and any one of exons 1-16 of CAND1. In another embodiment, the purified fusion protein is essentially free of other human proteins.

An aspect of the invention is directed to a synthetic nucleic acid encoding the EGFR fusion proteins described above.

An aspect of the invention is directed to a purified EGFR-SEPT14 fusion protein comprising SEQ ID NO: 1 or 5. In one embodiment, the purified fusion protein is essentially free of other human proteins.

An aspect of the invention is directed to a purified EGFR-SEPT14 fusion protein having a genomic breakpoint comprising SEQ ID NO: 4. In another embodiment, the purified fusion protein is essentially free of other human proteins.

An aspect of the invention is directed to a purified EGFR-PSPH fusion protein comprising SEQ ID NO: 7 or 11. In another embodiment, the purified fusion protein is essentially free of other human proteins.

An aspect of the invention is directed to a purified EGFR-PSPH fusion protein having a genomic breakpoint comprising SEQ ID NO: 10. In a embodiment, the purified fusion protein is essentially free of other human proteins.

An aspect of the invention is directed to a purified EGFR-CAND1 fusion protein comprising SEQ ID NO: 13 or 8495. In one embodiment, the purified fusion protein is essentially free of other human proteins.

An aspect of the invention is directed to a purified EGFR-CAND1 fusion protein having a genomic breakpoint comprising SEQ ID NO: 15. In one embodiment, the purified fusion protein is essentially free of other human proteins.

An aspect of the invention is directed to a synthetic nucleic acid encoding an EGFR-SEPT14 fusion protein comprising SEQ ID NO: 2.

An aspect of the invention is directed to a synthetic nucleic acid encoding an EGFR-SEPT14 fusion protein having a genomic breakpoint comprising SEQ ID NO: 4.

An aspect of the invention is directed to a synthetic nucleic acid encoding an EGFR-PSPH fusion protein comprising SEQ ID NO: 8.

An aspect of the invention is directed to a synthetic nucleic acid encoding an EGFR-PSPH fusion protein having a genomic breakpoint comprising SEQ ID NO: 10.

An aspect of the invention is directed to a synthetic nucleic acid encoding an EGFR-CAND1 fusion protein comprising SEQ ID NO: 14.

An aspect of the invention is directed to a synthetic nucleic acid encoding an EGFR-CAND1 fusion protein having a genomic breakpoint comprising SEQ ID NO: 15.

An aspect of the invention is directed to an antibody or antigen-binding fragment thereof that specifically binds to a purified fusion protein comprising a tyrosine kinase domain of an EGFR protein fused to a polypeptide that constitutively activates the tyrosine kinase domain of the EGFR protein. In one embodiment, the fusion protein is an EGFR-SEPT fusion protein, an EGFR-PSPH fusion protein, or an EGFR-CAND fusion protein. In another embodiment, the EGFR-SEPT fusion protein is EGFR-SEPT14. In one embodiment, the EGFR-SEPT fusion protein comprises the amino acid sequence of SEQ ID NO: 1, 3, or 5. In one embodiment, the EGFR-CAND fusion protein is EGFR-CAND1. In one embodiment, the EGFR-CAND fusion protein comprises the amino acid sequence of SEQ ID NO: 13, 16, or 8495.

An aspect of the invention is directed to an antibody or antigen-binding fragment thereof that specifically binds to a purified fusion protein comprising a tyrosine kinase domain of an EGFR protein fused to a polypeptide comprising the coiled-coil domain of a Septin protein. In another embodiment, the EGFR-SEPT fusion protein is EGFR-SEPT14. In one embodiment, the EGFR-SEPT fusion protein comprises the amino acid sequence of SEQ ID NO: 1, 3, or 5.

An aspect of the invention is directed to an antibody or antigen-binding fragment thereof that specifically binds to a purified fusion protein comprising a tyrosine kinase domain of an EGFR protein fused to a polypeptide comprising a phosphoserine phosphatase (PSPH) protein. In one embodiment, the EGFR-PSPH fusion protein comprises the amino acid sequence of SEQ ID NO: 7, 9, or 11.

An aspect of the invention is directed to an antibody or antigen-binding fragment thereof, that specifically binds to a purified fusion protein comprising a tyrosine kinase domain of an EGFR protein fused to a polypeptide comprising a Cullin-associated and neddylation-dissociated (CAND) protein. In one embodiment, the EGFR-CAND fusion protein is EGFR-CAND1. In one embodiment, the EGFR-CAND fusion protein comprises the amino acid sequence of SEQ ID NO: 13, 16, or 8495.

An aspect of the invention is directed to a composition for decreasing the expression level or activity of a fusion protein in a subject comprising the tyrosine kinase domain of an EGFR protein fused to a polypeptide that constitutively activates the tyrosine kinase domain of the EGFR protein, the composition in an admixture of a pharmaceutically acceptable carrier comprising an inhibitor of the fusion protein. In one embodiment, the inhibitor comprises an antibody that specifically binds to an EGFR-SEPT fusion protein, an EGFR-PSPH fusion protein, an EGFR-CAND fusion protein, or a fragment thereof; a small molecule that specifically binds to an EGFR protein; an antisense RNA or antisense DNA that decreases expression of an EGFR-SEPT fusion protein, an EGFR-PSPH fusion protein, an EGFR-CAND fusion; a siRNA that specifically targets an EGFR-SEPT fusion gene, an EGFR-PSPH fusion gene, or an EGFR-CAND; or a combination thereof. In another embodiment, the CAND protein is CAND1. In a further embodiment, the SEPT protein is SEPT14. In some embodiments, the small molecule that specifically binds to an EGFR protein comprises AZD4547, NVP-BGJ398, PD173074, NF449, TK1258, BIBF-1120, BMS-582664, AZD-2171, TSU68, AB1010, AP24534, E-7080, LY2874455, or a combination thereof.

An aspect of the invention is directed to a method for treating a gene-fusion associated cancer in a subject in need thereof, the method comprising administering to the subject an effective amount of an EGFR fusion molecule inhibitor. In one embodiment, the gene-fusion associated cancer comprises glioblastoma multiforme, breast cancer, lung cancer, prostate cancer, or colorectal carcinoma. In one embodiment, the EGFR fusion comprises an EGFR protein fused to a polypeptide that constitutively activates the tyrosine kinase domain of the EGFR protein. In one embodiment, the EGFR fusion protein is an EGFR-SEPT14 fusion protein, an EGFR-PSPH fusion protein, or an EGFR-CAND1 fusion protein. In one embodiment, the inhibitor comprises an antibody that specifically binds to an EGFR-SEPT fusion protein, an EGFR-PSPH fusion protein, an EGFR-CAND fusion protein, or a fragment thereof; a small molecule that specifically binds to an EGFR protein; an antisense RNA or antisense DNA that decreases expression of an EGFR-SEPT fusion protein, an EGFR-PSPH fusion protein, an EGFR-CAND fusion; a siRNA that specifically targets an EGFR-SEPT fusion gene, an EGFR-PSPH fusion gene, or an EGFR-CAND; or a combination thereof. In one embodiment, the small molecule that specifically binds to an EGFR protein comprises AZD4547, NVP-BGJ398, PD173074, NF449, TK1258, BIBF-1120, BMS-582664, AZD-2171, TSU68, AB1010, AP24534, E-7080, LY2874455, or a combination thereof.

An aspect of the invention is directed to a method of decreasing growth of a solid tumor in a subject in need thereof; the method comprising administering to the subject an effective amount of an EGFR fusion molecule inhibitor, wherein the inhibitor decreases the size of the solid tumor. In one embodiment, the subject is afflicted with a gene-fusion associated cancer. In one embodiment, the gene-fusion associated cancer comprises glioblastoma multiforme, breast cancer, lung cancer, prostate cancer, or colorectal carcinoma. In one embodiment, the solid tumor comprises glioblastoma multiforme, breast cancer, lung cancer, prostate cancer, or colorectal carcinoma. In one embodiment, the EGFR fusion comprises an EGFR protein fused to a polypeptide that constitutively activates the tyrosine kinase domain of the EGFR protein. In one embodiment, the EGFR fusion protein is an EGFR-SEPT14 fusion protein, an EGFR-PSPH fusion protein, or an EGFR-CAND1 fusion protein. In one embodiment, the inhibitor comprises an antibody that specifically binds to an EGFR-SEPT fusion protein, an EGFR-PSPH fusion protein, an EGFR-CAND fusion protein, or a fragment thereof; a small molecule that specifically binds to an EGFR protein; an antisense RNA or antisense DNA that decreases expression of an EGFR-SEPT fusion protein, an EGFR-PSPH fusion protein, an EGFR-CAND fusion; a siRNA that specifically targets an EGFR-SEPT fusion gene, an EGFR-PSPH fusion gene, or an EGFR-CAND; or a combination thereof. In one embodiment, the small molecule that specifically binds to an EGFR protein comprises AZD4547, NVP-BGJ398, PD173074, NF449, TK1258, BIBF-1120, BMS-582664, AZD-2171, TSU68, AB1010, AP24534, E-7080, LY2874455, or a combination thereof.

An aspect of the invention is directed to a method of reducing cell proliferation in a subject afflicted with a gene-fusion associated cancer, the method comprising administering to the subject an effective amount of an EGFR fusion molecule inhibitor, wherein the inhibitor decreases cell proliferation. In one embodiment, the gene-fusion associated cancer comprises glioblastoma multiforme, breast cancer, lung cancer, prostate cancer, or colorectal carcinoma. In one embodiment, the EGFR fusion comprises an EGFR protein fused to a polypeptide that constitutively activates the tyrosine kinase domain of the EGFR protein. In one embodiment, the EGFR fusion protein is an EGFR-SEPT14 fusion protein, an EGFR-PSPH fusion protein, or an EGFR-CAND1 fusion protein. In one embodiment, the inhibitor comprises an antibody that specifically binds to an EGFR-SEPT fusion protein, an EGFR-PSPH fusion protein, an EGFR-CAND fusion protein, or a fragment thereof; a small molecule that specifically binds to an EGFR protein; an antisense RNA or antisense DNA that decreases expression of an EGFR-SEPT fusion protein, an EGFR-PSPH fusion protein, an EGFR-CAND fusion; a siRNA that specifically targets an EGFR-SEPT fusion gene, an EGFR-PSPH fusion gene, or an EGFR-CAND; or a combination thereof. In one embodiment, the small molecule that specifically binds to an EGFR protein comprises AZD4547, NVP-BGJ398, PD173074, NF449, TK1258, BIBF-1120, BMS-582664, AZD-2171, TSU68, AB1010, AP24534, E-7080, LY2874455, or a combination thereof.

An aspect of the invention is directed to a diagnostic kit for determining whether a sample from a subject exhibits a presence of an EGFR fusion, the kit comprising at least one oligonucleotide that specifically hybridizes to an EGFR fusion, or a portion thereof. In one embodiment, the oligonucleotides comprise a set of nucleic acid primers or in situ hybridization probes. In another embodiment, the oligonucleotide comprises SEQ ID NOS 32, 33, 34, 35, 36, 37, 38, 39, 40, 41, 42, 43, 44, 45, 87, 88, 89, or a combination thereof. In a further embodiment, the primers prime a polymerase reaction only when an EGFR fusion is present. In some embodiments, the fusion protein is an EGFR-SEPT14 fusion protein, an EGFR-PSPH fusion protein, or an EGFR-CAND1 fusion protein. In other embodiments, the determining comprises gene sequencing, selective hybridization, selective amplification, gene expression analysis, or a combination thereof.

An aspect of the invention is directed to a diagnostic kit for determining whether a sample from a subject exhibits a presence of an EGFR fusion protein, the kit comprising an antibody that specifically binds to an EGFR fusion protein comprising SEQ ID NO: 1, 3, 5, 7, 9, 11, 13, 16, or 8495, wherein the antibody will recognize the protein only when an EGFR fusion protein is present. In one embodiment, the fusion protein is an EGFR-SEPT14 fusion protein, an EGFR-PSPH fusion protein, or an EGFR-CAND1 fusion protein. In one embodiment, the subject is afflicted with a gene-fusion associated cancer. In one embodiment, the gene-fusion associated cancer comprises glioblastoma multiforme, breast cancer, lung cancer, prostate cancer, or colorectal carcinoma.

An aspect of the invention is directed to a method for detecting the presence of an EGFR fusion in a human subject. The method comprises obtaining a biological sample from the human subject; and detecting whether or not there is an EGFR fusion present in the subject. In one embodiment, the detecting comprises measuring EGFR fusion protein levels by ELISA using an antibody directed to SEQ ID NO: 1, 3, 5, 7, 9, 11, 13, 16, or 8495; western blot using an antibody directed to SEQ ID NO: 1, 3, 5, 7, 9, 11, 13, 16, or 8495; mass spectroscopy, isoelectric focusing, or a combination thereof.

An aspect of the invention is directed to a method for detecting the presence of an EGFR fusion in a human subject. The method comprises obtaining a biological sample from a human subject; and detecting whether or not there is a nucleic acid sequence encoding an EGFR fusion protein in the subject. In one embodiment, the nucleic acid sequence comprises any one of SEQ ID NOS: 2, 4, 8, 10, 14, and 15. In another embodiment, the detecting comprises using hybridization, amplification, or sequencing techniques to detect an EGFR fusion. In a further embodiment, the amplification uses primers comprising SEQ ID NOS 32, 33, 34, 35, 36, 37, 38, 39, 40, 41, 42, 43, 44, 45, 87, 88, or 89. In some embodiments, the fusion protein is an EGFR-SEPT14 fusion protein, an EGFR-PSPH fusion protein, or an EGFR-CAND1 fusion protein.

BRIEF DESCRIPTION OF THE FIGURES

To conform to the requirements for PCT patent applications, many of the figures presented herein are black and white representations of images originally created in color. In the below descriptions and the examples, the colored plots and images are described in terms of its appearance in black and white. The original color versions can be viewed in Frattini et al., (2013) Nature Genetics, 45(10):1141-49 (including the accompanying Supplementary Information available in the on-line version of the manuscript available on the Nature Genetics web site). For the purposes of the PCT, the contents of Frattini et al., (2013) Nature Genetics, 45(10):1141-49, including the accompanying "Supplementary Information," are herein incorporated by reference.

FIG. 2A shows lysates from 293T cells transfected with vectors expressing LZTR-1 and the Flag-Cul3 wild type (WT), Flag-Cul3-dominant negative (DN) or the empty vector were immunoprecipitated with Flag antibody and assayed by western blot with the indicated antibodies. *, non specific band; left bracket indicates Cul3 polypeptides. The molecular weight is indicated on the right. FIG. 2B shows homology model of the Kelch (green; grey in black and white image of left hand side of ribbon diagram), BTB (cyan; (light grey in black and white image of center and right of ribbon diagram) and BACK (purple; dark grey in black and white image of center and right of ribbon diagram) domains of LZTR-1 with the Cul3 N-terminal domain (white) docked onto the putative binding site. GBM mutations are indicated in red (dark grey in black and white image; left hand side of ribbon diagram).

FIG. 4C. EGFR-SEPT14 gene fusion identified by whole transcriptome sequencing. EGFR-Septin14 fusion protein sequence (SEQ ID NO: 5) and schematics. Regions corresponding to EGFR and Septin14 are shown in blue (left hand side of diagram; (grey in black and white image; sequence comprising "MRP . . . VIQ" amino acids of SEQ ID NO: 5) and red (right hand side of diagram; light grey in black and white image; sequence comprising "LQD . . . RKK" amino acids of SEQ ID NO: 5), respectively. The fusion joins the tyrosine kinase domain of EGFR and the Coiled-coil domain of Septin14.

FIG. 5D. Expression of EGFR-SEPT14 fusion promotes an aggressive phenotype and inhibition of EGFR kinase delays GBM growth in vivo. In vivo inhibition of tumor growth by EGFR kinase inhibitors in glioma patient derived xenografts carrying EGFR-SEPT14 fusion but not wild type EGFR. T-C indicates the median difference in survival between drug treated and vehicle (control) treated mice.

FIG. 10A. Pattern of somatic mutations, CNVs and expression of CTNND2 in GBM. Schematic representation of identified somatic mutations in CTNND2 shown in the context of the known domain structure of the protein. Numbers refer to amino acid residues of the δ-catenin protein.

FIG. 14A. CAND1-EGFR gene fusion identified by whole transcriptome sequencing. Split reads are shown aligning on the breakpoint. The predicted reading frame at the breakpoint is shown at the top with CAND1 sequences in blue (grey in black and white image; sequence comprising "TSA . . . LSR" amino acids of SEQ ID NO: 13 and "TTA . . . CAG" nucleotides of SEQ ID NO: 14) and EGFR in red (light grey in black and white image; sequence comprising "CTG . . . VGX" amino acids of SEQ ID NO: 13 and "ATC . . . GGC" nucleotides of SEQ ID NO: 14). The amino acid sequence (TOP) is SEQ ID NO: 13; the nucleotide sequence (bottom) is SEQ ID NO: 14.

FIG. 14C. CAND1-EGFR gene fusion identified by whole transcriptome sequencing. CAND1-EGFR fusion protein sequence (SEQ ID NO: 8495). Regions corresponding to CAND1 and EGFR are shown in blue (grey in black and white image; sequence comprising "MAS . . . LSR" amino acids of SEQ ID NO: 8495) and red (grey in black and white image; sequence comprising "CTG . . . IGA*" amino acids of SEQ ID NO: 8495), respectively.

FIG. 14D. CAND1-EGFR gene fusion identified by whole transcriptome sequencing. Genomic fusion of CAND1 intron 4 with intron 15 of EGFR. In the fuse mRNA exon 4 of CAND1 is spliced 5' to exon 16 of EGFR.

FIG. 18A shows a pattern of expression of δ-catenin in the developing brain, as determined by immunostaining. Double immunofluorescence staining of brain cortex using δ-catenin antibody (red; dark grey in black and white image (center)) and βIII-tubulin (green; light grey in black and white image (right)); Nuclei are counterstained with Dapi (blue; grey in black and white image (Left)). FIG. 18B shows a pattern of expression of δ-catenin in the adult brain, as determined by immunostaining. Upper panels, Double immunofluorescence staining of brain cortex using δ-catenin antibody (red; dark grey in black and white image (center)) and MAP2 (green; light grey in black and white image (right)); Nuclei are counterstained with Dapi (blue; grey in black and white image (Left)). Lower panels, Double immunofluorescence staining of brain cortex using δ-catenin antibody (red; dark grey in black and white image) and GFAP (green; light grey in black and white image); Nuclei are counterstained with Dapi (blue; grey in black and white image).

FIG. 19A is a photographic microscopy image of immunofluorescence for fibronectin, collagen-5α1 (COL5A1) and smooth muscle actin (SMA) in glioma spheres #48 four days after infection with lentiviruses expressing δ-catenin or the empty vector. Nuclei are counterstained with Dapi. FIG. 19B is a bar graph showing the quantification of fluorescence intensity for SMA, COL5A1 and FBN for cultures treated as in a. n=3 independent experiments; data indicate mean±SD.

FIG. 19D are photographic microscopy images showing time course analysis of βIII-tubulin expression in glioma spheres #48 transduced with lentiviruses expressing CTNND2 or the empty vector. Note the loss from the advanced culture of βIII-Tubulin expressing cells.

FIGS. 19E-F are graphs. FIG. 19E shows a linear regression plot of in vitro limiting dilution assay using GBM-derived cells #48 expressing vector or δ-catenin. The frequency of sphere forming cells was 7.42±1.16 and 0.88±0.02 for vector and δ-catenin, respectively (p=0.0098). Error bars are SD. FIG. 19F shows a longitudinal analysis of bioluminescence imaging in mice injected intracranially with GBM-derived line 48 expressing vector or δ-catenin. n=3 mice for vector and 5 for δ-catenin. Data are mean±SEM of photon counts.

FIGS. 20A-E show the functional analysis of EGFR-SEPT14 fusion and effect of inhibition of EGFR kinase on glioma growth. FIG. 20A is a graph of a sphere forming assay in the absence of EGF of GBM-derived primary cells (#48) expressing vector, EGFR wild type, EGFR Viii or EGFR-SEP14 fusion. Data are Mean±SD of triplicate samples (p=0.0051 and 0.027 for EGFR-SEP14 fusion and EGFR Viii compared with vector, respectively). FIG. 20B is a western blot analysis of GBM-derived primary cells (#48) expressing vector, EGFR Viii or EGFR-SEP14 fusion cultured in the presence of EGF. FIG. 20C is a photohraphic image of a blot showing GBM-derived cells (#48) expressing vector, EGFR Viii or EGFR-SEP14 fusion that were cultured in the absence of EGF for 48 h and then stimulated with EGF 20 ng/ml for the indicated time. Cells were assayed by western blot using the indicated antibodies. FIG. 20D is a graph of GSEA showing up-regulation of STAT3 target genes in primary human GBM carrying the EGFR-SEPT14 fusion gene [Enrichment Score (ES)=0.738; P (family-wise error rate, FWER)=0.000 q (false discovery rate, FDR)=0.000]. FIG. 20E is a bar graph showing the survival of GBM-derived cells (#48) expressing vector, EGFR wild type, EGFR Viii or EGFR-SEP14 fusion after treatment with lapatinib for 48 h at the indicated concentrations. Data are Mean±SD of triplicate samples.

FIG. 22A are photographic microscopy images of immunofluorescence staining of human primary GBM included in tissue microarrays (TMA) using δ-catenin antibody (red; darkt grey in black and white image); Nuclei are counterstained with Dapi (blue; grey in black and white image). Two representative δ-catenin-positive and two δ-catenin-negative tumors are shown in the upper and lower panels, respectively. FIG. 22B is a Western Blot analysis of the expression of δ-catenin in a panel of GBM-derived glioma sphere cultures. Brain, normal human brain. Arrowhead indicated δ-catenin; Asterisk, non-specific band. Vinculin is shown as control for loading.

FIG. 23A is a western blot using the indicated antibodies in glioma cells expressing δ-catenin or the empty vector. Vinculin is shown as control for loading. FIG. 23B are photographic microscopy images showing U87 glioma cells transduced with a lentivirus expressing wild type δ-catenin, δ-catenin GBM-derived mutants or the empty vector were analyzed by fluorescence microscopy.

FIG. 27 shows gene fusions identified through RNA sequencing.

FIG. 28 shows genomic breakpoints of gene fusions detected through whole-exome DNA sequencing.

FIG. 29 shows that an EGFR fusion molecule can also include a tyrosine kinase domain of an EGFR protein fused to a protein encoded by any one of the genes.

FIG. 30 shows relative expression of EGFR fusion and wild-type transcripts. Expression is estimated using the depth of reads covering the fusion breakpoint or wild-type exon junctions excluded from the fusion transcript. These wild-type exons include exons 25-26, 26-27, and 27-28.

FIG. 31 shows genomic breakpoints of gene fusions detected through whole-exome DNA sequencing.

FIG. 32 shows an analysis of the incidence of EGFR-SEPT14 and EGFR-PSPH gene fusions in GBM harboring or not the EGFRvIII rearrangement.

FIG. 33 shows enrichment of classical/mesenchymal subtype among samples with EGFR-SEPT14 or EGFR-PSPH.

FIG. 34 shows antibodies and concentrations used in immunofluorescence staining.

FIG. 35 shows antibodies and concentrations used for Western blots and immunopreciptation assays.

FIG. 36 shows primers used for screening gene fusions from cDNA.

FIG. 37 shows primers used for genomic detection of gene fusions.

FIG. 38 shows primers used for semiquantitative RT-PCR to detect exogenous Myc-LZTR1 WT and mutant LZTR1-R801W

DETAILED DESCRIPTION OF THE INVENTION

Figure 1A:
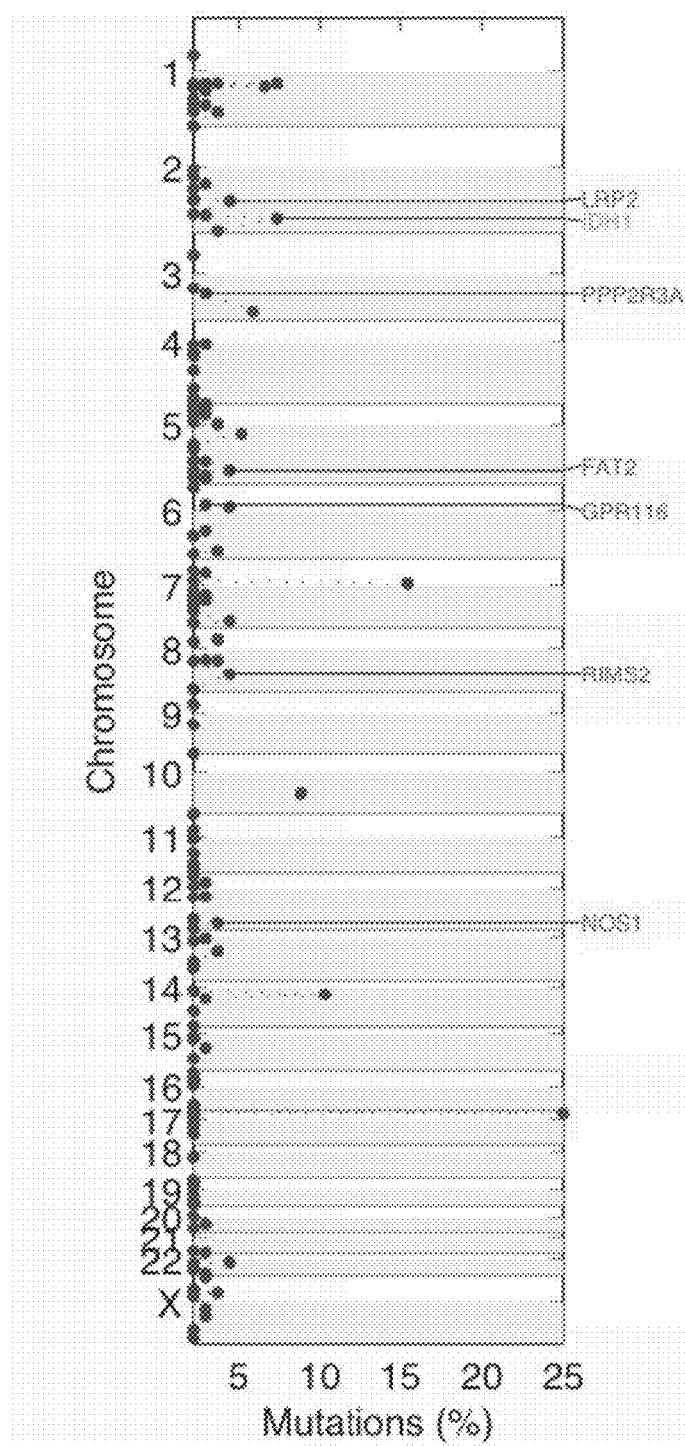
FIG. 1A is a chromosome view of validated GBM genes scoring at the top of each of the three categories by MutComFocal. The plot shows mutated genes without significant copy number alterations (Mut, mutation %, frequency of mutations). Previously known GBM genes are indicated in green (light grey in black and white image), new and independently validated GBM genes are indicated in red (dark grey in black and white image).

Gene fusions retaining the RTK-coding domain of EGFR are the most frequent gene fusion events in GBM. EGFR gene fusions occur in 7.6% of GBM patients and frequently implicate the Sept14 gene as the 3' partner in the fusion, with a consistent breakpoint at the RNA level. This makes the EGFR fusions highly manageable genetic alterations both diagnostically and therapeutically. In one embodiment, EGFR fusions enhance the proliferative and migratory capacity of glioma cells. In another embodiment, the EGFR fusions also confer sensitivity to EGFR inhibition to human GBM grown as mouse xenografts. Gene fusions encompassing RTK-coding genes are thus implicated in the pathogenesis of GBM and provide a strong rationale for the inclusion of GBM patients harboring EGFR fusions in clinical trials based on EGFR inhibitors. The target population of GBM patients who may carry EGFR gene fusions can benefit from targeted inhibition of EGFR kinase activity, and is estimated to correspond to 20,000 patients per year world-wide (1,000 in USA/year).

Glioblastoma multiformes (GBMs) are the most common form of brain tumors in adults accounting for 12-15% of intracranial tumors and 50-60% of primary brain tumors. GBM is among the most lethal forms of human cancer. The history of successful targeted therapy of cancer largely coincides with the inactivation of recurrent and oncogenic gene fusions in hematological malignancies and recently in some types of epithelial cancer. GBM is among the most lethal and incurable forms of human cancer. Targeted therapies against common genetic alterations in GBM have not changed the dismal clinical outcome of the disease, most likely because they have systematically failed to eradicate the truly addicting oncoprotein activities of GBM. Recurrent chromosomal rearrangements resulting in the creation of oncogenic gene fusions have not been found in GBM.

GBM is among the most difficult forms of cancer to treat in humans (1). So far, the therapeutic approaches that have been tested against potentially important oncogenic targets in GBM have met limited success (2-4). Recurrent chromosomal translocations leading to production of oncogenic fusion proteins are viewed as initiating and addicting events in the pathogenesis of human cancer, thus providing the most desirable molecular targets for cancer therapy (5, 6). Recurrent and oncogenic gene fusions have not been found in GBM. Chromosomal rearrangements are hallmarks of hematological malignancies but recently they have also been uncovered in subsets of solid tumors (breast, prostate, lung and colorectal carcinoma) (7, 8). Important and successful targeted therapeutic interventions for patients whose tumors carry these rearrangements have stemmed from the discovery of functional gene fusions, especially when the translocations involve kinase-coding genes (BCR-ABL, EML4-ALK) (9, 10). GBM, the most common malignant brain tumor, remains one of the most challenging forms of cancer to treat. The abundance of passenger mutations and large regions of copy number alterations has complicated the definition of the landscape of driver mutations in glioblastoma.

A hallmark of GBM is rampant chromosomal instability (CIN), which leads to aneuploidy (11). CIN and aneuploidy are early events in the pathogenesis of cancer (12). Without being bound by theory, genetic alterations targeting mitotic fidelity might be responsible for missegregation of chromosomes during mitosis, resulting in aneuploidy (13, 14).

Epidermal growth factor receptors (EGFR) are transmembrane glycoproteins and members of the protein kinase superfamily. This protein is a receptor for members of the epidermal growth factor family. EGFR is a cell surface protein that binds to epidermal growth factor. Binding of the protein to a ligand induces receptor dimerization and tyrosine autophosphorylation and leads to cell proliferation. Mutations that lead to EGFR overexpression or overactivity have been associated with a number of cancers, including lung cancer, anal cancers and glioblastoma multiforme.

Phosphoserine phosphatase (PSPH) is an enzyme responsible for the third and last step in L-serine formation. It catalyzes magnesium-dependent hydrolysis of L-phosphoserine and is also involved in an exchange reaction between L-serine and L-phosphoserine. Deficiency of this protein is thought to be linked to Williams syndrome.

The singular forms "a," "an," and "the" include plural reference unless the context clearly dictates otherwise.

The term "about" is used herein to mean approximately, in the region of, roughly, or around. When the term "about" is used in conjunction with a numerical range, it modifies that range by extending the boundaries above and below the numerical values set forth. In general, the term "about" is used herein to modify a numerical value above and below the stated value by a variance of 20%.

DNA and Amino Acid Manipulation Methods and Purification Thereof

The practice of aspects of the present invention can employ, unless otherwise indicated, conventional techniques of cell biology, cell culture, molecular biology, transgenic biology, microbiology, recombinant DNA, and immunology, which are within the skill of the art. Such techniques are explained fully in the literature. See, e.g., *Molecular Cloning A Laboratory Manual,* 3rd Ed., ed. by Sambrook (2001), Fritsch and Maniatis (Cold Spring Harbor Laboratory Press: 1989); *DNA Cloning, Volumes I and II* (D. N. Glover ed., 1985); *Oligonucleotide Synthesis* (M. J. Gait ed., 1984); Mullis et al. U.S. Pat. No. 4,683,195; *Nucleic Acid Hybridization* (B. D. Hames & S. J. Higgins eds. 1984); *Transcription and Translation* (B. D. Hames & S. J. Higgins eds. 1984); *Culture Of Animal Cells* (R. I. Freshney, Alan R. Liss, Inc., 1987); *Immobilized Cells and Enzymes* (IRL Press, 1986); B. Perbal, *A Practical Guide To Molecular Cloning* (1984); the series, *Methods In Enzymology* (Academic Press, Inc., N.Y.), specifically, *Methods In Enzymology,* Vols. 154 and 155 (Wu et al. eds.); *Gene Transfer Vectors For Mammalian Cells* (J. H. Miller and M. P. Calos eds., 1987, Cold Spring Harbor Laboratory); *Immunochemical Methods In Cell And Molecular Biology* (Caner and Walker, eds., Academic Press, London, 1987); *Handbook Of Experimental Immunology, Volumes I-IV* (D. M. Weir and C. C. Blackwell, eds., 1986); *Manipulating the Mouse Embryo*, (Cold Spring Harbor Laboratory Press, Cold Spring Harbor, N.Y., 1986). All patents, patent applications and references cited herein are incorporated by reference in their entireties.

One skilled in the art can obtain a protein in several ways, which include, but are not limited to, isolating the protein via biochemical means or expressing a nucleotide sequence encoding the protein of interest by genetic engineering methods.

A protein is encoded by a nucleic acid (including, for example, genomic DNA, complementary DNA (cDNA), synthetic DNA, as well as any form of corresponding RNA). For example, it can be encoded by a recombinant nucleic acid of a gene. The proteins of the invention can be obtained from various sources and can be produced according to various techniques known in the art. For example, a nucleic acid that encodes a protein can be obtained by screening DNA libraries, or by amplification from a natural source. A protein can be a fragment or portion thereof. The nucleic acids encoding a protein can be produced via recombinant DNA technology and such recombinant nucleic acids can be prepared by conventional techniques, including chemical synthesis, genetic engineering, enzymatic techniques, or a combination thereof. For example, a fusion protein of the invention comprises a tyrosine kinase domain of an EGFR protein fused to a polypeptide that constitutively activates the tyrosine kinase domain of the EGFR protein. For example, the fusion protein can be an EGFR-SEPT fusion protein, an EGFR-PSPH fusion protein, or an EGFR-CAND fusion protein. An example of an EGFR-SEPT fusion protein is EGFR-SEPT14. In one embodiment, an EGFR-SEPT14 fusion polypeptide can have the amino acid sequence shown in SEQ ID NO: 1, 3, or 5. An example of an EGFR-PSPH fusion protein is a polypeptide having the amino acid sequence shown in SEQ ID NO: 7, 9, or 11. An example of an EGFR-CAND fusion protein is EGFR-CAND1. In one embodiment, an EGFR-CAND1 fusion polypeptide can have the amino acid sequence shown in SEQ ID NO: 13, 16, or 8495.

The Genbank ID for the EGFR gene is 1956. Four isoforms are listed for EGFR, e.g., having Genebank Accession Nos. NP_005219 (corresponding nucleotide sequence NM_005228); NP_958439 (corresponding nucleotide sequence NM_201282); NP_958440 (corresponding nucleotide sequence NM_201283); NP_958441 (corresponding nucleotide sequence NM_201284). The nucleotide and amino acid sequences can be readily obtained by one of ordinary skill in the art using the listed accession numbers.

The Genbank ID for the SEPT14 gene is 346288. The Genebank Accession No. for SEPT14 is NP_997249 (corresponding nucleotide sequence NM_207366). The nucleotide and amino acid sequences can be readily obtained by one of ordinary skill in the art using the listed accession numbers.

The Genbank ID for the PSPH gene is 5723. The Genebank Accession No. for PSPH is NP_004568 (corresponding nucleotide sequence NM_004577). The nucleotide and amino acid sequences can be readily obtained by one of ordinary skill in the art using the listed accession numbers.

The Genbank ID for the CAND1 gene is 55832. The Genebank Accession No. for CAND1 is NP_060918 (corresponding nucleotide sequence NM_018448). The nucleotide and amino acid sequences can be readily obtained by one of ordinary skill in the art using the listed accession numbers.

As used herein, an "EGFR fusion molecule" can be a nucleic acid which encodes a polypeptide corresponding to a fusion protein comprising a tyrosine kinase domain of an EGFR protein fused to a polypeptide that constitutively activates the tyrosine kinase domain of the EGFR protein. For example, an EGFR fusion molecule can include an EGFR-SEPT fusion (e.g., an EGFR-SEPT14 fusion polypeptide comprising the amino acid sequence shown in SEQ ID NO: 1, 3, or 5, or comprising the nucleic acid sequence shown in SEQ ID NO: 2 or 4); an EGFR-PSPH fusion, (e.g., comprising the amino acid sequence shown in SEQ ID NO: 7, 9, or 11, or comprising the nucleic acid sequence shown in SEQ ID NO: 8 or 10), or an EGFR-CAND fusion (e.g., an EGFR-CAND1 fusion polypeptide comprising the amino acid sequence shown in SEQ ID NO: 13, 16, or 8495, or comprising the nucleic acid sequence shown in SEQ ID NO: 14 or 15). For example, an EGFR fusion molecule can include an EGFR-containing fusion comprising the amino acid sequence corresponding to Genebank Accession no. NP_005219, NP_958439, NP_958440, or NP_958441. AN EGFR fusion molecule can also include a tyrosine kinase domain of an EGFR protein fused to a protein encoded by any one of the genes listed in FIG. 29. AN EGFR fusion molecule can include a variant of the above described examples, such as a fragment thereof.

The nucleic acid can be any type of nucleic acid, including genomic DNA, complementary DNA (cDNA), recombinant DNA, synthetic or semi-synthetic DNA, as well as any form of corresponding RNA. A cDNA is a form of DNA artificially synthesized from a messenger RNA template and is used to produce gene clones. A synthetic DNA is free of modifications that can be found in cellular nucleic acids and include, but are not limited to, histones and methylation. For example, a nucleic acid encoding anan EGFR EGFR fusion molecule can comprise a recombinant nucleic acid encoding such a protein. The nucleic acid can be a non-naturally occurring nucleic acid created artificially (such as by assembling, cutting, ligating or amplifying sequences). It can be double-stranded or single-stranded.

The invention further provides for nucleic acids that are complementary to an EGFR fusion molecule. Complementary nucleic acids can hybridize to the nucleic acid sequence described above under stringent hybridization conditions. Non-limiting examples of stringent hybridization conditions include temperatures above 30° C., above 35° C., in excess of 42° C., and/or salinity of less than about 500 mM, or less than 200 mM. Hybridization conditions can be adjusted by the skilled artisan via modifying the temperature, salinity and/or the concentration of other reagents such as SDS or SSC.

According to the invention, protein variants can include amino acid sequence modifications. For example, amino acid sequence modifications fall into one or more of three classes: substitutional, insertional or deletional variants. Insertions can include amino and/or carboxyl terminal fusions as well as intrasequence insertions of single or multiple amino acid residues. Insertions ordinarily will be smaller insertions than those of amino or carboxyl terminal fusions, for example, on the order of one to four residues. Deletions are characterized by the removal of one or more amino acid residues from the protein sequence. These variants ordinarily are prepared by site-specific mutagenesis of nucleotides in the DNA encoding the protein, thereby producing DNA encoding the variant, and thereafter expressing the DNA in recombinant cell culture.

In one embodiment, an EGFR fusion molecule comprises a protein or polypeptide encoded by a nucleic acid sequence encoding an EGFR fusion molecule, such as the sequences shown in SEQ ID NOS: 2, 4, 8, 10, 14, or 15. In some embodiments, the nucleic acid sequence encoding an EGFR fusion molecule is about 70%, about 75%, about 80%, about 85%, about 90%, about 93%, about 95%, about 97%, about 98%, or about 99% identical to SEQ ID NOS: 2, 4, 8, 10, 14, or 15. In another embodiment, the polypeptide can be modified, such as by glycosylations and/or acetylations and/or chemical reaction or coupling, and can contain one or several non-natural or synthetic amino acids. An example of an EGFR fusion molecule is the polypeptide having the amino acid sequence shown in SEQ ID NOS: 1, 3, 5, 7, 9, 11, 13, 16, or 8495. In some embodiments, the EGFR fusion molecule that is a polypeptide is about 70%, about 75%, about 80%, about 85%, about 90%, about 93%, about 95%, about 97%, about 98%, or about 99% identical to SEQ ID NOS: 1, 3, 5, 7, 9, 11, 13, 16, or 8495. In another embodiment, an EGFR fusion molecule can be a fragment of an EGFR fusion protein. For example, the EGFR fusion molecule can encompass any portion of at least about 8 consecutive amino acids of SEQ ID NOS: 1, 3, 5, 7, 9, 11, 13, 16, or 8495. The fragment can comprise at least about 10 amino acids, a least about 20 amino acids, at least about 30 amino acids, at least about 40 amino acids, at least about 50 amino acids, at least about 60 amino acids, or at least about 75 amino acids of SEQ ID NOS: 1, 3, 5, 7, 9, 11, 13, 16, or 8495. Fragments include all possible amino acid lengths between about 8 and about 100 amino acids, for example, lengths between about 10 and about 100 amino acids, between about 15 and about 100 amino acids, between about 20 and about 100 amino acids, between about 35 and about 100 amino acids, between about 40 and about 100 amino acids, between about 50 and about 100 amino acids, between about 70 and about 100 amino acids, between about 75 and about 100 amino acids, or between about 80 and about 100 amino acids. Fragments include all possible amino acid lengths between about 100 and 800 amino acids, for example, lengths between about 125 and 800 amino acids, between about 150 and 800 amino acids, between about 175 and 800 amino acids, between about 200 and 800 amino acids, between about 225 and 800 amino acids, between about 250 and 800 amino acids, between about 275 and 800 amino acids, between about 300 and 800 amino acids, between about 325 and 800 amino acids, between about 350 and 800 amino acids, between about 375 and 800 amino acids, between about 400 and 800 amino acids, between about 425 and 800 amino acids, between about 450 and 800 amino acids, between about 475 and 800 amino acids, between about 500 and 800 amino acids, between about 525 and 800 amino acids, between about 550 and 800 amino acids, between about 575 and 800 amino acids, between about 600 and 800 amino acids, between about 625 and 800 amino acids, between about 650 and 800 amino acids, between about 675 and 800 amino acids, between about 700 and 800 amino acids, between about 725 and 800 amino acids, between about 750 and 800 amino acids, or between about 775 and 800 amino acids.

Chemical Synthesis.

Nucleic acid sequences encoding an EGFR fusion molecule can be synthesized, in whole or in part, using chemical methods known in the art. Alternatively, a polypeptide can be produced using chemical methods to synthesize its amino acid sequence, such as by direct peptide synthesis using solid-phase techniques. Protein synthesis can either be performed using manual techniques or by automation. Automated synthesis can be achieved, for example, using Applied Biosystems 431A Peptide Synthesizer (Perkin Elmer).

Optionally, polypeptides fragments can be separately synthesized and combined using chemical methods to produce a full-length molecule. For example, these methods can be utilized to synthesize a fusion protein of the invention. In one embodiment, a fusion protein of the invention comprises a tyrosine kinase domain of an EGFR protein fused to a polypeptide that constitutively activates the tyrosine kinase domain of the EGFR protein. For example, the fusion protein can be an EGFR-SEPT fusion protein, an EGFR-PSPH fusion protein, or an EGFR-CAND fusion protein. An example of an EGFR-SEPT fusion protein is EGFR-SEPT14. In one embodiment, an EGFR-SEPT14 fusion polypeptide can have the amino acid sequence shown in SEQ ID NO: 1, 3, or 5. An example of an EGFR-PSPH fusion protein is a polypeptide having the amino acid sequence shown in SEQ ID NO: 7, 9, or 11. An example of an EGFR-CAND fusion protein is EGFR-CAND1. In one embodiment, an EGFR-CAND1 fusion polypeptide can have the amino acid sequence shown in SEQ ID NO: 13, 16, or 8495.

Obtaining, Purifying and Detecting EGFR Fusion Molecules.

A polypeptide encoded by a nucleic acid, such as a nucleic acid encoding an EGFR fusion molecule, or a variant thereof, can be obtained by purification from human cells expressing a protein or polypeptide encoded by such a nucleic acid. Non-limiting purification methods include size exclusion chromatography, ammonium sulfate fractionation, ion exchange chromatography, affinity chromatography, and preparative gel electrophoresis.

A synthetic polypeptide can be substantially purified via high performance liquid chromatography (HPLC), such as ion exchange chromatography (IEX-HPLC). The composition of a synthetic polypeptide, such as an EGFR fusion molecule, can be confirmed by amino acid analysis or sequencing.

Other constructions can also be used to join a nucleic acid sequence encoding a polypeptide/protein of the claimed invention to a nucleotide sequence encoding a polypeptide domain which will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). Including cleavable linker sequences (i.e., those specific for Factor Xa or enterokinase (Invitrogen, San Diego, Calif.)) between the purification domain and a polypeptide encoded by a nucleic acid of the invention also can be used to facilitate purification. For example, the skilled artisan can use an expression vector encoding 6 histidine residues that precede a thioredoxin or an enterokinase cleavage site in conjunction with a nucleic acid of interest. The histidine residues facilitate purification by immobilized metal ion affinity chromatography, while the enterokinase cleavage site provides a means for purifying the polypeptide encoded by, for example, an EGFR-SEPT, EGFR-CAND, EGFR-PSPH, or EGFR-containing, nucleic acid.

Host cells which contain a nucleic acid encoding an EGFR fusion molecule, and which subsequently express the same, can be identified by various procedures known to those of skill in the art. These procedures include, but are not limited to, DNA-DNA or DNA-RNA hybridizations and protein bioassay or immunoassay techniques which include membrane, solution, or chip-based technologies for the detection and/or quantification of nucleic acid or protein. For example, the presence of a nucleic acid encoding an EGFR fusion molecule can be detected by DNA-DNA or DNA-RNA hybridization or amplification using probes or fragments of nucleic acids encoding the same. In one embodiment, a nucleic acid fragment of an EGFR fusion molecule can encompass any portion of at least about 8 consecutive nucleotides of SEQ ID NOS: 2, 8, or 14. In another embodiment, the fragment can comprise at least about 10 consecutive nucleotides, at least about 15 consecutive nucleotides, at least about 20 consecutive nucleotides, or at least about 30 consecutive nucleotides of SEQ ID NOS: 2, 8, or 14. Fragments can include all possible nucleotide lengths between about 8 and about 100 nucleotides, for example, lengths between about 15 and about 100 nucleotides, or between about 20 and about 100 nucleotides. Nucleic acid amplification-based assays involve the use of oligonucleotides selected from sequences encoding an EGFR fusion molecule nucleic acid, or EGFR fusion molecule nucleic acid to detect transformants which contain a nucleic acid encoding a protein or polypeptide of the same.

Protocols are known in the art for detecting and measuring the expression of a polypeptide encoded by a nucleic acid, such as a nucleic acid encoding an EGFR fusion molecule, using either polyclonal or monoclonal antibodies specific for the polypeptide. Non-limiting examples include enzyme-linked immunosorbent assay (ELISA), radioimmunoassay (RIA), and fluorescence activated cell sorting (FACS). A two-site, monoclonal-based immunoassay using monoclonal antibodies reactive to two non-interfering epitopes on a polypeptide encoded by a nucleic acid, such as a nucleic acid encoding an EGFR fusion molecule, can be used, or a competitive binding assay can be employed.

Labeling and conjugation techniques are known by those skilled in the art and can be used in various nucleic acid and amino acid assays. Methods for producing labeled hybridization or PCR probes for detecting sequences related to nucleic acid sequences encoding a protein, such as EGFR fusion molecule, include, but are not limited to, oligolabeling, nick translation, end-labeling, or PCR amplification using a labeled nucleotide. Alternatively, nucleic acid sequences, such as nucleic acids encoding an EGFR fusion molecule, can be cloned into a vector for the production of an mRNA probe. Such vectors are known in the art, are commercially available, and can be used to synthesize RNA probes in vitro by addition of labeled nucleotides and an appropriate RNA polymerase such as T7, T3, or SP6. These procedures can be conducted using a variety of commercially available kits (Amersham Pharmacia Biotech, Promega, and US Biochemical). Suitable reporter molecules or labels which can be used for ease of detection include radionuclides, enzymes, and fluorescent, chemiluminescent, or chromogenic agents, as well as substrates, cofactors, inhibitors, and/or magnetic particles.

A fragment can be a fragment of a protein, such as an EGFR fusion protein. For example, a fragment of an EGFR fusion can encompass any portion of at least about 8 consecutive amino acids of SEQ ID NOS: 1, 3, 5, 7, 9, 11, 13, 16, or 8495. The fragment can comprise at least about 10 consecutive amino acids, at least about 20 consecutive amino acids, at least about 30 consecutive amino acids, at least about 40 consecutive amino acids, a least about 50 consecutive amino acids, at least about 60 consecutive amino acids, at least about 70 consecutive amino acids, at least about 75 consecutive amino acids, at least about 80 consecutive amino acids, at least about 85 consecutive amino acids, at least about 90 consecutive amino acids, at least about 95 consecutive amino acids, at least about 100 consecutive amino acids, at least about 200 consecutive amino acids, at least about 300 consecutive amino acids, at least about 400 consecutive amino acids, at least about 500 consecutive amino acids, at least about 600 consecutive amino acids, at least about 700 consecutive amino acids, or at least about 800 consecutive amino acids of SEQ ID NOS: 1, 3, 5, 7, 9, 11, 13, 16, or 8495. Fragments include all possible amino acid lengths between about 8 and 100 about amino acids, for example, lengths between about 10 and about 100 amino acids, between about 15 and about 100 amino acids, between about 20 and about 100 amino acids, between about 35 and about 100 amino acids, between about 40 and about 100 amino acids, between about 50 and about 100 amino acids, between about 70 and about 100 amino acids, between about 75 and about 100 amino acids, or between about 80 and about 100 amino acids.

Cell Transfection

Host cells transformed with a nucleic acid sequence of interest can be cultured under conditions suitable for the expression and recovery of the protein from cell culture. The polypeptide produced by a transformed cell can be secreted or contained intracellularly depending on the sequence and/or the vector used. Expression vectors containing a nucleic acid sequence, such as a nucleic acid encoding an EGFR fusion molecule, can be designed to contain signal sequences which direct secretion of soluble polypeptide molecules encoded by the nucleic acid. Cell transfection and culturing methods are described in more detail below.

A eukaryotic expression vector can be used to transfect cells in order to produce proteins encoded by nucleotide sequences of the vector, e.g. those encoding an EGFR fusion molecule. Mammalian cells can contain an expression vector (for example, one that contains a nucleic acid encoding a fusion protein comprising a tyrosine kinase domain of an EGFR protein fused to a polypeptide that constitutively activates the tyrosine kinase domain of the EGFR protein) via introducing the expression vector into an appropriate host cell via methods known in the art.

A host cell strain can be chosen for its ability to modulate the expression of the inserted sequences or to process the expressed polypeptide encoded by a nucleic acid, in the desired fashion. Such modifications of the polypeptide include, but are not limited to, acetylation, carboxylation, glycosylation, phosphorylation, lipidation, and acylation. Post-translational processing which cleaves a "prepro" form of the polypeptide also can be used to facilitate correct insertion, folding and/or function. Different host cells which have specific cellular machinery and characteristic mechanisms for post-translational activities (e.g., CHO, HeLa, MDCK, HEK293, and WI38), are available from the American Type Culture Collection (ATCC; 10801 University Boulevard, Manassas, Va. 20110-2209) and can be chosen to ensure the correct modification and processing of the foreign protein.

An exogenous nucleic acid can be introduced into a cell via a variety of techniques known in the art, such as lipofection, microinjection, calcium phosphate or calcium chloride precipitation, DEAE-dextran-mediated transfection, or electroporation. Electroporation is carried out at approximate voltage and capacitance to result in entry of the DNA construct(s) into cells of interest (such as glioma cells (cell line SF188), neuroblastoma cells (cell lines IMR-32, SK-N-SH, SH-F and SH-N), astrocytes and the like). Other transfection methods also include modified calcium phosphate precipitation, polybrene precipitation, liposome fusion, and receptor-mediated gene delivery.

Cells that will be genetically engineered can be primary and secondary cells obtained from various tissues, and include cell types which can be maintained and propagated in culture. Non-limiting examples of primary and secondary cells include epithelial cells, neural cells, endothelial cells, glial cells, fibroblasts, muscle cells (such as myoblasts) keratinocytes, formed elements of the blood (e.g., lymphocytes, bone marrow cells), and precursors of these somatic cell types.

Vertebrate tissue can be obtained by methods known to one skilled in the art, such a punch biopsy or other surgical methods of obtaining a tissue source of the primary cell type of interest. In one embodiment, a punch biopsy or removal (e.g., by aspiration) can be used to obtain a source of cancer cells (for example, glioma cells, neuroblastoma cells, and the like). A mixture of primary cells can be obtained from the tissue, using methods readily practiced in the art, such as explanting or enzymatic digestion (for examples using enzymes such as pronase, trypsin, collagenase, elastase dispase, and chymotrypsin). Biopsy methods have also been described in U.S. Pat. No. 7,419,661 and PCT application publication WO 2001/32840, and each are hereby incorporated by reference.

Primary cells can be acquired from the individual to whom the genetically engineered primary or secondary cells are administered. However, primary cells can also be obtained from a donor, other than the recipient, of the same species. The cells can also be obtained from another species (for example, rabbit, cat, mouse, rat, sheep, goat, dog, horse, cow, bird, or pig). Primary cells can also include cells from an isolated or purified vertebrate tissue source grown attached to a tissue culture substrate (for example, flask or dish) or grown in a suspension; cells present in an explant derived from tissue; both of the aforementioned cell types plated for the first time; and cell culture suspensions derived from these plated cells. Secondary cells can be plated primary cells that are removed from the culture substrate and replated, or passaged, in addition to cells from the subsequent passages. Secondary cells can be passaged one or more times. These primary or secondary cells can contain expression vectors having a gene that encodes an EGFR fusion molecule.

Cell Culturing

Various culturing parameters can be used with respect to the host cell being cultured. Appropriate culture conditions for mammalian cells are well known in the art (Cleveland W L, et al., *J Immunol Methods,* 1983, 56(2): 221-234) or can be determined by the skilled artisan (see, for example, *Animal Cell Culture: A Practical Approach 2nd Ed.,* Rickwood, D. and Hames, B. D., eds. (Oxford University Press: New York, 1992)). Cell culturing conditions can vary according to the type of host cell selected. Commercially available medium can be utilized. Non-limiting examples of medium include, for example, Minimal Essential Medium (MEM, Sigma, St. Louis, Mo.); Dulbecco's Modified Eagles Medium (DMEM, Sigma); Ham's F10 Medium (Sigma); HyClone cell culture medium (HyClone, Logan, Utah); RPMI-1640 Medium (Sigma); and chemically-defined (CD) media, which are formulated for various cell types, e.g., CD-CHO Medium (Invitrogen, Carlsbad, Calif.).

The cell culture media can be supplemented as necessary with supplementary components or ingredients, including optional components, in appropriate concentrations or amounts, as necessary or desired. Cell culture medium solutions provide at least one component from one or more of the following categories: (1) an energy source, usually in the form of a carbohydrate such as glucose; (2) all essential amino acids, and usually the basic set of twenty amino acids plus cysteine; (3) vitamins and/or other organic compounds required at low concentrations; (4) free fatty acids or lipids, for example linoleic acid; and (5) trace elements, where trace elements are defined as inorganic compounds or naturally occurring elements that can be required at very low concentrations, usually in the micromolar range.

The medium also can be supplemented electively with one or more components from any of the following categories: (1) salts, for example, magnesium, calcium, and phosphate; (2) hormones and other growth factors such as, serum, insulin, transferrin, and epidermal growth factor; (3) protein and tissue hydrolysates, for example peptone or peptone mixtures which can be obtained from purified gelatin, plant material, or animal byproducts; (4) nucleosides and bases such as, adenosine, thymidine, and hypoxanthine; (5) buffers, such as HEPES; (6) antibiotics, such as gentamycin or ampicillin; (7) cell protective agents, for example pluronic polyol; and (8) galactose. In one embodiment, soluble factors can be added to the culturing medium.

The mammalian cell culture that can be used with the present invention is prepared in a medium suitable for the type of cell being cultured. In one embodiment, the cell culture medium can be any one of those previously discussed (for example, MEM) that is supplemented with serum from a mammalian source (for example, fetal bovine serum (FBS)). In another embodiment, the medium can be a conditioned medium to sustain the growth of host cells.

Three-dimensional cultures can be formed from agar (such as Gey's Agar), hydrogels (such as matrigel, agarose, and the like; Lee et al., (2004) *Biomaterials* 25: 2461-2466) or polymers that are cross-linked. These polymers can comprise natural polymers and their derivatives, synthetic polymers and their derivatives, or a combination thereof. Natural polymers can be anionic polymers, cationic polymers, amphipathic polymers, or neutral polymers. Non-limiting examples of anionic polymers can include hyaluronic acid, alginic acid (alginate), carageenan, chondroitin sulfate, dextran sulfate, and pectin. Some examples of cationic polymers, include but are not limited to, chitosan or polylysine. (Peppas et al., (2006) *Adv Mater.* 18: 1345-60; Hoffman, A. S., (2002) *Adv Drug Deliv Rev.* 43: 3-12; Hoffman, A. S., (2001) *Ann NY Acad Sci* 944: 62-73). Examples of amphipathic polymers can include, but are not limited to collagen, gelatin, fibrin, and carboxymethyl chitin. Non-limiting examples of neutral polymers can include dextran, agarose, or pullulan. (Peppas et al., (2006) *Adv Mater.* 18: 1345-60; Hoffman, A. S., (2002) *Adv Drug Deliv Rev.* 43: 3-12; Hoffman, A. S., (2001) *Ann NY Acad Sci* 944: 62-73).

Cells to be cultured can harbor introduced expression vectors, such as plasmids. The expression vector constructs can be introduced via transformation, microinjection, transfection, lipofection, electroporation, or infection. The expression vectors can contain coding sequences, or portions thereof, encoding the proteins for expression and production. Expression vectors containing sequences encoding the produced proteins and polypeptides, as well as the appropriate transcriptional and translational control elements, can be generated using methods well known to and practiced by those skilled in the art. These methods include synthetic techniques, in vitro recombinant DNA techniques, and in vivo genetic recombination which are described in J. Sambrook et al., 2001, *Molecular Cloning, A Laboratory Manual,* Cold Spring Harbor Press, Plainview, N.Y. and in F. M. Ausubel et al., 1989, *Current Protocols in Molecular Biology,* John Wiley & Sons, New York, N.Y.

EGFR Fusion Molecule Inhibitors

The invention provides methods for use of compounds that decrease the expression level or activity of an EFGR EGFR fusion molecule in a subject. In addition, the invention provides methods for using compounds for the treatment of a gene-fusion associated cancer. In one embodiment, the gene-fusion associated cancer comprises glioblastoma multiforme, breast cancer, lung cancer, prostate cancer, or colorectal carcinoma.

As used herein, an "EGFR fusion molecule inhibitor" refers to a compound that interacts with an EGFR fusion molecule of the invention and modulates its activity and/or its expression. For example, the compound can decrease the activity or expression of an EGFR fusion molecule. The compound can be an antagonist of an EGFR fusion molecule (e.g., an EGFR fusion molecule inhibitor). Some non-limiting examples of EGFR fusion molecule inhibitors include peptides (such as peptide fragments comprising an EGFR fusion molecule, or antibodies or fragments thereof), small molecules, and nucleic acids (such as siRNA or antisense RNA specific for a nucleic acid comprising an EGFR fusion molecule). Antagonists of an EGFR fusion molecule decrease the amount or the duration of the activity of an EGFR fusion protein. In one embodiment, the fusion protein comprises a tyrosine kinase domain of an EGFR protein fused to a polypeptide that constitutively activates the tyrosine kinase domain of the EGFR protein (e.g., EGFR-SEPT (such as EFGR-SEPT14), EGFR-PSPH, or EGFR-CAND (such as EGFR-CAND1)). Antagonists include proteins, nucleic acids, antibodies, small molecules, or any other molecule which decrease the activity of an EGFR fusion molecule.

The term "modulate," as it appears herein, refers to a change in the activity or expression of an EGFR fusion molecule. For example, modulation can cause a decrease in protein activity, binding characteristics, or any other biological, functional, or immunological properties of an EGFR fusion molecule, such as an EGFR fusion protein.

In one embodiment, an EGFR fusion molecule inhibitor can be a peptide fragment of an EGFR fusion protein that binds to the protein itself.

For example, the EGFR fusion polypeptide can encompass any portion of at least about 8 consecutive amino acids of SEQ ID NOS: 1, 3, 5, 7, 9, 11, 13, 16, or 8495. The fragment can comprise at least about 10 consecutive amino acids, at least about 20 consecutive amino acids, at least about 30 consecutive amino acids, at least about 40 consecutive amino acids, a least about 50 consecutive amino acids, at least about 60 consecutive amino acids, at least about 70 consecutive amino acids, at least about 75 consecutive amino acids, at least about 80 consecutive amino acids, at least about 85 consecutive amino acids, at least about 90 consecutive amino acids, at least about 95 consecutive amino acids, at least about 100 consecutive amino acids, at least about 200 consecutive amino acids, at least about 300 consecutive amino acids, at least about 400 consecutive amino acids, at least about 500 consecutive amino acids, at least about 600 consecutive amino acids, at least about 700 consecutive amino acids, or at least about 800 consecutive amino acids of SEQ ID NOS: 1, 3, 5, 7, 9, 11, 13, 16, or 8495. Fragments include all possible amino acid lengths between about 8 and 100 about amino acids, for example, lengths between about 10 and about 100 amino acids, between about 15 and about 100 amino acids, between about 20 and about 100 amino acids, between about 35 and about 100 amino acids, between about 40 and about 100 amino acids, between about 50 and about 100 amino acids, between about 70 and about 100 amino acids, between about 75 and about 100 amino acids, or between about 80 and about 100 amino acids. These peptide fragments can be obtained commercially or synthesized via liquid phase or solid phase synthesis methods (Atherton et al., (1989) *Solid Phase Peptide Synthesis: a Practical Approach*. IRL Press, Oxford, England). The EGFR fusion peptide fragments can be isolated from a natural source, genetically engineered, or chemically prepared. These methods are well known in the art.

An EGFR fusion molecule inhibitor can be a protein, such as an antibody (monoclonal, polyclonal, humanized, chimeric, or fully human), or a binding fragment thereof, directed against an EGFR fusion molecule. An antibody fragment can be a form of an antibody other than the full-length form and includes portions or components that exist within full-length antibodies, in addition to antibody fragments that have been engineered. Antibody fragments can include, but are not limited to, single chain Fv (scFv), diabodies, Fv, and (Fab')$_2$, triabodies, Fc, Fab, CDR1, CDR2, CDR3, combinations of CDR's, variable regions, tetrabodies, bifunctional hybrid antibodies, framework regions, constant regions, and the like (see, Maynard et al., (2000) *Ann. Rev. Biomed. Eng.* 2:339-76; Hudson (1998) *Curr. Opin. Biotechnol.* 9:395-402). Antibodies can be obtained commercially, custom generated, or synthesized against an antigen of interest according to methods established in the art (see U.S. Pat. Nos. 6,914,128, 5,780,597, and 5,811,523; Roland E. Kontermann and Stefan Dübel (editors), *Antibody Engineering, Vol. I & II*, (2010) 2$^{nd}$ ed., Springer; Antony S. Dimitrov (editor), *Therapeutic Antibodies: Methods and Protocols* (*Methods in Molecular Biology*), (2009), Humana Press; Benny Lo (editor) *Antibody Engineering: Methods and Protocols* (*Methods in Molecular Biology*), (2004) Humana Press, each of which are hereby incorporated by reference in their entireties). For example, antibodies directed to an EGFR fusion molecule can be obtained commercially from Abcam, Santa Cruz Biotechnology, Abgent, R&D Systems, Novus Biologicals, etc. Human antibodies directed to an EGFR fusion molecule (such as monoclonal, humanized, fully human, or chimeric antibodies) can be useful antibody therapeutics for use in humans. In one embodiment, an antibody or binding fragment thereof is directed against SEQ ID NOS: 1, 3, 5, 7, 9, 11, 13, 16, or 8495.

Inhibition of RNA encoding an EGFR fusion molecule can effectively modulate the expression of an EGFR fusion molecule. Inhibitors are selected from the group comprising: siRNA; interfering RNA or RNAi; dsRNA; RNA Polymerase III transcribed DNAs; ribozymes; and antisense nucleic acids, which can be RNA, DNA, or an artificial nucleic acid.

Antisense oligonucleotides, including antisense DNA, RNA, and DNA/RNA molecules, act to directly block the translation of mRNA by binding to targeted mRNA and preventing protein translation. For example, antisense oligonucleotides of at least about 15 bases and complementary to unique regions of the DNA sequence encoding an EGFR fusion molecule can be synthesized, e.g., by conventional phosphodiester techniques (Dallas et al., (2006) *Med. Sci. Monit.* 12(4):RA67-74; Kalota et al., (2006) *Handb. Exp. Pharmacol.* 173:173-96; Lutzelburger et al., (2006) *Handb. Exp. Pharmacol.* 173:243-59). Antisense nucleotide sequences include, but are not limited to: morpholinos, 2'-O-methyl polynucleotides, DNA, RNA and the like.

siRNA comprises a double stranded structure containing from about 15 to about 50 base pairs, for example from about 21 to about 25 base pairs, and having a nucleotide sequence identical or nearly identical to an expressed target gene or RNA within the cell. The siRNA comprise a sense RNA strand and a complementary antisense RNA strand annealed together by standard Watson-Crick base-pairing interactions. The sense strand comprises a nucleic acid sequence which is substantially identical to a nucleic acid sequence contained within the target miRNA molecule. "Substantially identical" to a target sequence contained within the target mRNA refers to a nucleic acid sequence that differs from the target sequence by about 3% or less. The sense and antisense strands of the siRNA can comprise two complementary, single-stranded RNA molecules, or can comprise a single molecule in which two complementary portions are base-paired and are covalently linked by a single-stranded "hairpin" area. See also, McMnaus and Sharp (2002) *Nat Rev Genetics,* 3:737-47, and Sen and Blau (2006) *FASEB J.,* 20:1293-99, the entire disclosures of which are herein incorporated by reference.

The siRNA can be altered RNA that differs from naturally-occurring RNA by the addition, deletion, substitution and/or alteration of one or more nucleotides. Such alterations can include addition of non-nucleotide material, such as to the end(s) of the siRNA or to one or more internal nucleotides of the siRNA, or modifications that make the siRNA resistant to nuclease digestion, or the substitution of one or more nucleotides in the siRNA with deoxyribonucleotides. One or both strands of the siRNA can also comprise a 3' overhang. As used herein, a 3' overhang refers to at least one unpaired nucleotide extending from the 3'-end of a duplexed RNA strand. For example, the siRNA can comprise at least one 3' overhang of from 1 to about 6 nucleotides (which includes ribonucleotides or deoxyribonucleotides) in length, or from 1 to about 5 nucleotides in length, or from 1 to about 4 nucleotides in length, or from about 2 to about 4 nucleotides in length. For example, each strand of the siRNA can comprise 3' overhangs of dithymidylic acid ("TT") or diuridylic acid ("uu").

siRNA can be produced chemically or biologically, or can be expressed from a recombinant plasmid or viral vector (for example, see U.S. Pat. No. 7,294,504 and U.S. Pat. No. 7,422,896, the entire disclosures of which are herein incorporated by reference). Exemplary methods for producing and testing dsRNA or siRNA molecules are described in U.S. Patent Application Publication No. 2002/0173478 to Gewirtz, U.S. Pat. No. 8,071,559 to Hannon et al., and in U.S. Pat. No. 7,148,342 to Tolentino et al., the entire disclosures of which are herein incorporated by reference.

In one embodiment, an siRNA directed to a human nucleic acid sequence comprising an EGFR fusion molecule can be generated against any one of SEQ ID NOS: 2, 4, 8, 10, 14, or 15. In another embodiment, an siRNA directed to a human nucleic acid sequence comprising a breakpoint of an EGFR fusion molecule can be generated against any one of SEQ ID NOS: 4, 10, or 15.

RNA polymerase III transcribed DNAs contain promoters, such as the U6 promoter. These DNAs can be transcribed to produce small hairpin RNAs in the cell that can function as siRNA or linear RNAs, which can function as antisense RNA. The EGFR fusion molecule inhibitor can comprise ribonucleotides, deoxyribonucleotides, synthetic nucleotides, or any suitable combination such that the target RNA and/or gene is inhibited. In addition, these forms of nucleic acid can be single, double, triple, or quadruple stranded. (See for example Bass (2001) *Nature,* 411:428-429; Elbashir et al., (2001) *Nature,* 411:494 498; U.S. Pat. No. 6,509,154; U.S. Patent Application Publication No. 2003/0027783; and PCT Publication Nos. WO 00/044895, WO 99/032619, WO 00/01846, WO 01/029058, WO 00/044914).

EGFR fusion molecule inhibitor can be a small molecule that binds to an EGFR fusion protein described herein and disrupts its function. Small molecules are a diverse group of synthetic and natural substances generally having low molecular weights. They can be isolated from natural sources (for example, plants, fungi, microbes and the like), are obtained commercially and/or available as libraries or collections, or synthesized. Candidate small molecules that inhibit an EGFR fusion protein can be identified via in silico screening or high-through-put (HTP) screening of combinatorial libraries according to methods established in the art (e.g., see Potyrailo et al., (2011) *ACS Comb Sci.* 13(6):579-633; Mensch et al., (2009) *J Pharm Sci.* 98(12):4429-68; Schnur (2008) *Curr Opin Drug Discov Devel.* 11(3):375-80; and Jhoti (2007) *Ernst Schering Found Symp Proc.* (3):169-85, each of which are hereby incorporated by reference in their entireties.) Most conventional pharmaceuticals, such as aspirin, penicillin, and many chemotherapeutics, are small molecules, can be obtained commercially, can be chemically synthesized, or can be obtained from random or combinatorial libraries as described below (see, e.g., Werner et al., (2006) *Brief Funct. Genomic Proteomic* 5(1):32-6).

Non-limiting examples of EGFR fusion molecule inhibitors include the EGFR inhibitors AZD4547 (see Gavine et al., (2012) *Cancer Res,* 72(8); 2045-56; see also PCT Application Publication No. WO2008/075068, each of which are hereby incorporated by reference in their entireties); NVP-BGJ398 (see Guagnano et al., (2011) *J. Med. Chem.,* 54:7066-7083; see also U.S. Patent Application Publication No. 2008-0312248 A1, each of which are hereby incorporated by reference in their entireties); PD173074 (see Guagnano et al., (2011) *J Med. Chem.,* 54:7066-7083; see also Mohammadi et al., (1998) *EMBO J.,* 17:5896-5904, each of which are hereby incorporated by reference in their entireties); NF449 (EMD Millipore (Billerica, Mass.) Cat. No. 480420; see also Krejci, (2010) the *Journal of Biological Chemistry,* 285(27):20644-20653, which is hereby incorporated by reference in its entirety); LY2874455 (Active Biochem; see Zhao et al. (2011) *Mol Cancer Ther.* (11): 2200-10; see also PCT Application Publication No. WO 2010129509, each of which are hereby incorporated by reference in their entireties); TKI258 (Dovitinib); BIBF-1120 (Intedanib-Vargatef); BMS-582664 (Brivanib alaninate); AZD-2171 (Cediranib); TSU-68 (Orantinib); AB-1010 (Masitinib); AP-24534 (Ponatinib); and E-7080 (by Eisai). A non-limiting example of an EGFR fusion molecule inhibitor includes the inhibitor KHS101 (Wurdak et al., (2010) *PNAS,* 107(38): 16542-47, which is hereby incorporated by reference in its entirety).

Structures of EGFR fusion molecule inhibitors useful for the invention include, but are not limited to: the EGFR inhibitor AZD4547, the EGFR inhibitor PD173074,
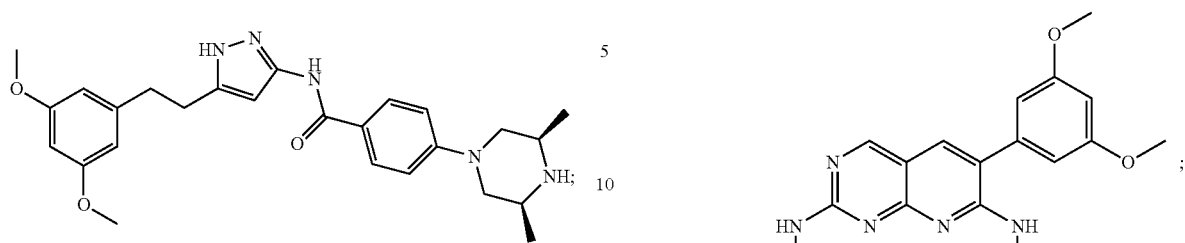
the EGFR inhibitor NVP-BGJ398,
the EGFR inhibitor LY2874455
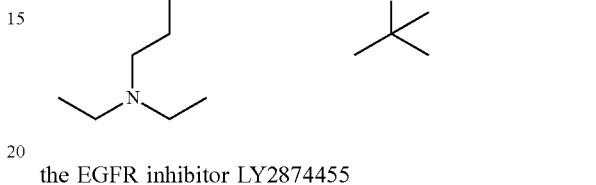
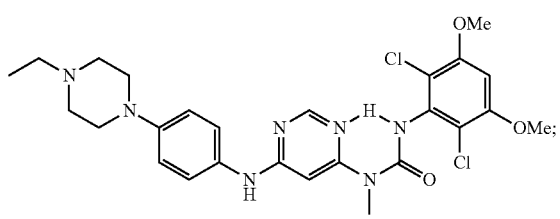
and the EGFR inhibitor NF449 (EMD Millipore (Billerica, Mass.) Cat. No. 480420),
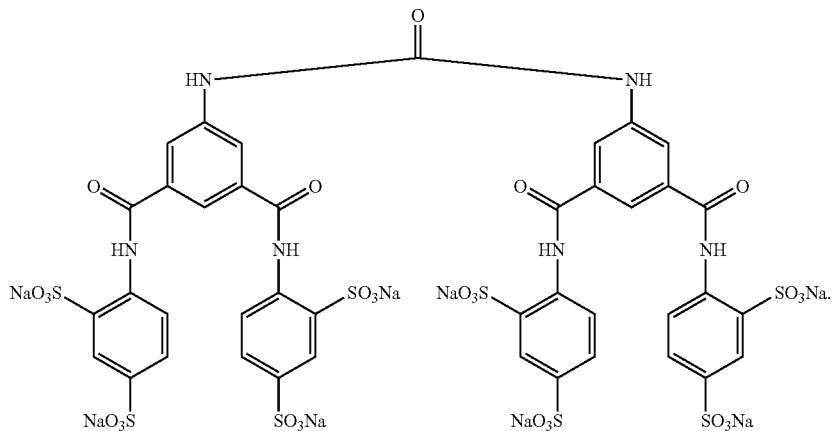

Other EGFR inhibitors include, but are not limited to:
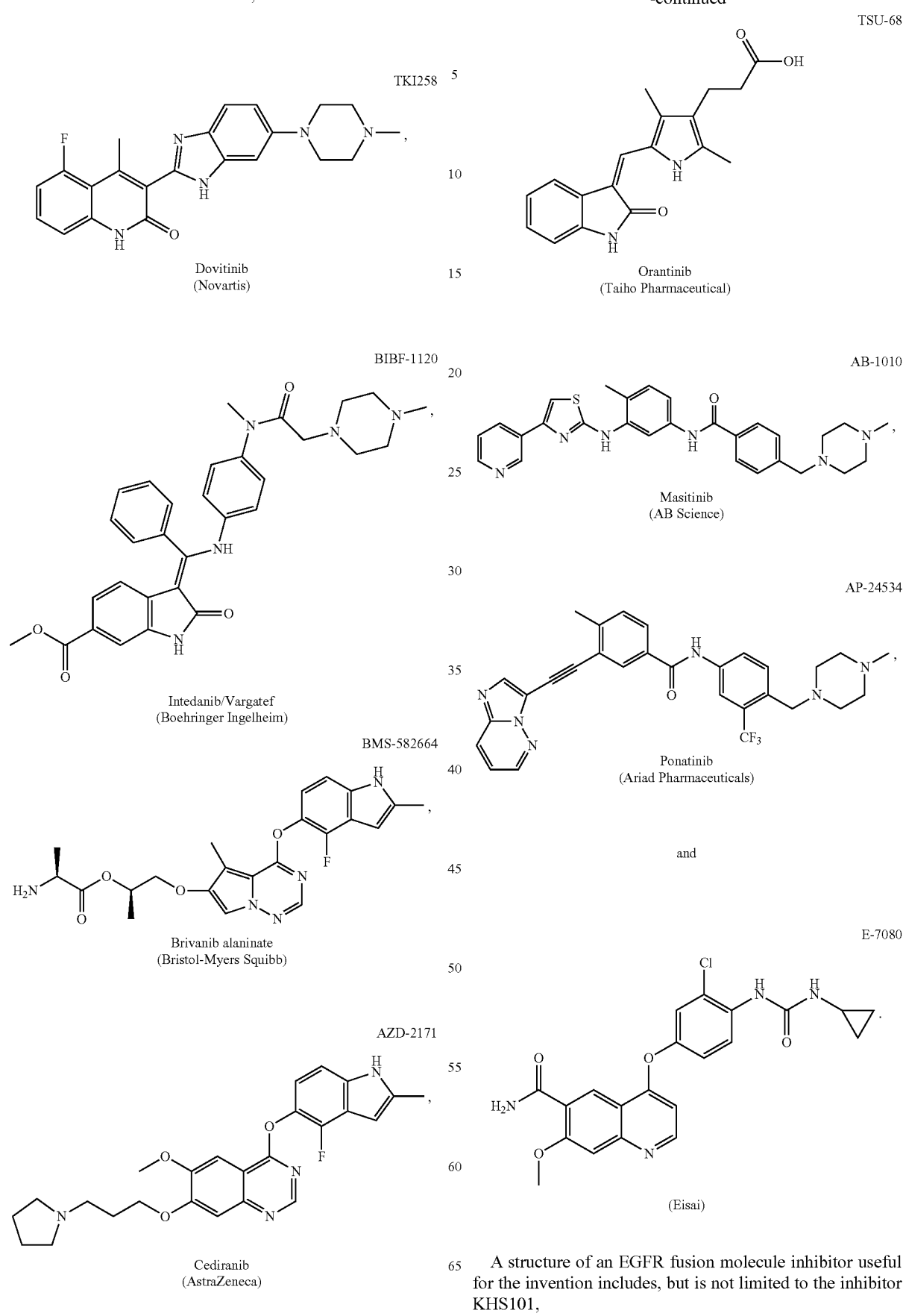
A structure of an EGFR fusion molecule inhibitor useful for the invention includes, but is not limited to the inhibitor KHS101,

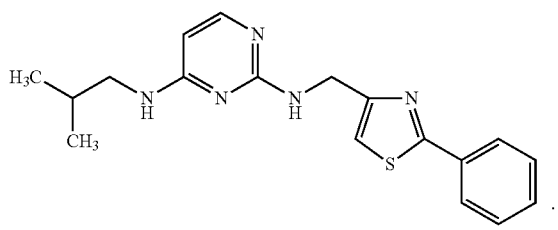 [SMILES: CC(C)CNc1ccnc(NCc2csc(-c3ccccc3)n2)n1]

Assessment and Therapeutic Treatment

The invention provides a method of decreasing the growth of a solid tumor in a subject. The tumor is associated with, but not limited to glioblastoma multiforme, breast cancer, lung cancer, prostate cancer, or colorectal carcinoma. In one embodiment, the method comprises detecting the presence of an EGFR fusion molecule in a sample obtained from a subject. In some embodiments, the sample is incubated with an agent that binds to an EFGR fusion molecule, such as an antibody, a probe, a nucleic acid primer, and the like. In further embodiments, the method comprises administering to the subject an effective amount of an EGFR fusion molecule inhibitor, wherein the inhibitor decreases the size of the solid tumor.

The invention also provides a method for treating or preventing a gene-fusion associated cancer in a subject, such as, but not limited to, glioblastoma multiforme, breast cancer, lung cancer, prostate cancer, or colorectal carcinoma. In one embodiment, the method comprises detecting the presence of an EGFR fusion molecule in a sample obtained from a subject, the presence of the fusion being indicative of a gene-fusion associated cancer, and, administering to the subject in need a therapeutic treatment against a gene-fusion associated cancer. In some embodiments, the sample is incubated with an agent that binds to an EFGR fusion molecule, such as an antibody, a probe, a nucleic acid primer, and the like.

The invention also provides a method for decreasing in a subject in need thereof the expression level or activity of a fusion protein comprising the tyrosine kinase domain of an EGFR protein fused to a polypeptide that constitutively activates the tyrosine kinase domain of the EGFR protein. In some embodiments, the method comprises obtaining a biological sample from the subject. In some embodiments, the sample is incubated with an agent that binds to an EGFR fusion molecule, such as an antibody, a probe, a nucleic acid primer, and the like. In some embodiments, the method comprises administering to the subject a therapeutic amount of a composition comprising an admixture of a pharmaceutically acceptable carrier an inhibitor of the fusion protein of the invention. In another embodiment, the method further comprises determining the fusion protein expression level or activity. In another embodiment, the method further comprises detecting whether the fusion protein expression level or activity is decreased as compared to the fusion protein expression level or activity prior to administration of the composition, thereby decreasing the expression level or activity of the fusion protein. In some embodiments, the fusion protein is an EGFR-PSPH fusion protein, an EGFR-CAND fusion protein, or an EGFR-SEPT fusion protein.

The administering step in each of the claimed methods can comprise a drug administration, such as EGFR fusion molecule inhibitor (for example, a pharmaceutical composition comprising an antibody that specifically binds to an EGFR-SEPT fusion protein, an EGFR-PSPH fusion protein, an EGFR-CAND fusion protein, or a fragment thereof; a small molecule that specifically binds to an EGFR protein; an antisense RNA or antisense DNA that decreases expression of an EGFR-SEPT fusion protein, an EGFR-PSPH fusion protein, an EGFR-CAND fusion; a siRNA that specifically targets an EGFR-SEPT fusion gene, an EGFR-PSPH fusion gene, or an EGFR-CAND). In one embodiment, the therapeutic molecule to be administered comprises a polypeptide of an EGFR fusion molecule, comprising at least about 75%, at least about 80%, at least about 85%, at least about 90%, at least about 93%, at least about 95%, at least about 97%, at least about 98%, at least about 99%, or 100% of the amino acid sequence of SEQ ID NOS: 1, 3, 5, 7, 9, 11, 13, 16, or 8495, and exhibits the function of decreasing expression of such a protein, thus treating a gene fusion-associated cancer. In another embodiment, administration of the therapeutic molecule decreases the size of the solid tumor associated with glioblastoma multiforme, breast cancer, lung cancer, prostate cancer, or colorectal carcinoma. In a further embodiment, administration of the therapeutic molecule decreases cell proliferation in a subject afflicted with a gene-fusion associated cancer.

In another embodiment, the therapeutic molecule to be administered comprises an siRNA directed to a human nucleic acid sequence comprising an EGFR fusion molecule. In one embodiment, the siRNA is directed to any one of SEQ ID NOS: 2, 4, 8, 10, 14, or 15. In a further embodiment, the therapeutic molecule to be administered comprises an antibody or binding fragment thereof, that is directed against SEQ ID NOS: 1, 3, 5, 7, 9, 11, 13, 16, or 8495. In some embodiments, the therapeutic molecule to be administered comprises a small molecule that specifically binds to an EGFR protein, such as AZD4547, NVP-BGJ398, PD173074, NF449, TK1258, BIBF-1120, BMS-582664, AZD-2171, TSU68, AB1010, AP24534, E-7080, or LY2874455.

An EGFR fusion molecule, for example, a fusion between EGFR and SEPT, PSPH, or CAND, can be determined at the level of the DNA, RNA, or polypeptide. Optionally, detection can be determined by performing an oligonucleotide ligation assay, a confirmation based assay, a hybridization assay, a sequencing assay, an allele-specific amplification assay, a microsequencing assay, a melting curve analysis, a denaturing high performance liquid chromatography (DHPLC) assay (for example, see Jones et al, (2000) *Hum Genet.*, 106(6):663-8), or a combination thereof. In one embodiment, the detection is performed by sequencing all or part of an EGFR fusion molecule (e.g., EGFR-SEPT fusion (such as an EGFR-SEPT14 fusion), EGFR-CAND fusion (such as an EGFR-CAND1 fusion), EGFR-PSPH), or by selective hybridization or amplification of all or part of an EGFR fusion molecule (e.g., EGFR-SEPT fusion (such as an EGFR-SEPT14 fusion), EGFR-CAND fusion (such as an EGFR-CAND1 fusion), EGFR-PSPH)). AN EGFR fusion molecule specific amplification (e.g., EGFR-SEPT (such as an EGFR-SEPT14), EGFR-CAND (such as an EGFR-CAND1), EGFR-PSPH nucleic acid specific amplification) can be carried out before the fusion identification step.

The invention provides for a method of detecting a chromosomal alteration in a subject afflicted with a gene-fusion associated cancer. In some embodiments, the gene-fusion associated cancer comprises glioblastoma multiforme, breast cancer, lung cancer, prostate cancer, or colorectal carcinoma. In one embodiment, the chromosomal alteration is an in-frame fused transcript described herein, for example an EGFR fusion molecule. An alteration in a chromosome region occupied by an EGFR fusion molecule such as a nucleic acid encoding an EGFR-SEPT fusion (such as an EGFR-SEPT14 fusion), an EGFR-CAND fusion (such as an EGFR-CAND1 fusion), or an EGFR-PSPH, can be any form of mutation(s), deletion(s), rearrangement(s) and/or insertions in the coding and/or non-coding region of the locus, alone or in various combination(s). Mutations can include point mutations. Insertions can encompass the addition of one or several residues in a coding or non-coding portion of the gene locus. Insertions can comprise an addition of between 1 and 50 base pairs in the gene locus. Deletions can encompass any region of one, two or more residues in a coding or non-coding portion of the gene locus, such as from two residues up to the entire gene or locus. Deletions can affect smaller regions, such as domains (introns) or repeated sequences or fragments of less than about 50 consecutive base pairs, although larger deletions can occur as well. Rearrangement includes inversion of sequences. The alteration in a chromosome region occupied by an EGFR fusion molecule, e.g., a nucleic acid encoding a an EGFR-SEPT fusion (such as an EGFR-SEPT14 fusion), an EGFR-CAND fusion (such as an EGFR-CAND1 fusion), or an EGFR-PSPH, can result in amino acid substitutions, RNA splicing or processing, product instability, the creation of stop codons, production of oncogenic fusion proteins, frame-shift mutations, and/or truncated polypeptide production. The alteration can result in the production of an EGFR fusion molecule, for example, a nucleic acid encoding an EGFR-SEPT fusion (such as an EGFR-SEPT14 fusion), an EGFR-CAND fusion (such as an EGFR-CAND1 fusion), or an EGFR-PSPH fusion, with altered function, stability, targeting or structure. The alteration can also cause a reduction, or even an increase in protein expression. In one embodiment, the alteration in the chromosome region occupied by an EGFR fusion molecule can comprise a chromosomal rearrangement resulting in the production of an EGFR fusion molecule, such as an EGFR-SEPT fusion (such as an EGFR-SEPT14 fusion), an EGFR-CAND fusion (such as an EGFR-CAND1 fusion), or an EGFR-PSPH fusion. This alteration can be determined at the level of the DNA, RNA, or polypeptide. In another embodiment, the detection or determination comprises nucleic acid sequencing, selective hybridization, selective amplification, gene expression analysis, or a combination thereof. In another embodiment, the detection or determination comprises protein expression analysis, for example by western blot analysis, ELISA, or other antibody detection methods.

The present invention provides a method for treating a gene-fusion associated cancer in a subject in need thereof. In one embodiment, the method comprises obtaining a sample from the subject to determine the level of expression of an EGFR fusion molecule in the subject. In some embodiments, the sample is incubated with an agent that binds to an EGFR fusion molecule, such as an antibody, a probe, a nucleic acid primer, and the like. In another embodiment, the detection or determination comprises nucleic acid sequencing, selective hybridization, selective amplification, gene expression analysis, or a combination thereof. In another embodiment, the detection or determination comprises protein expression analysis, for example by western blot analysis, ELISA, or other antibody detection methods. In some embodiments, the method further comprises assessing whether to administer an EGFR fusion molecule inhibitor based on the expression pattern of the subject. In further embodiments, the method comprises administering an EGFR fusion molecule inhibitor to the subject. In one embodiment, the gene-fusion associated cancer comprises glioblastoma multiforme, breast cancer, lung cancer, prostate cancer, or colorectal carcinoma.

In one embodiment, the invention provides for a method of detecting the presence of altered RNA expression of an EFGR fusion molecule in a subject, for example, one afflicted with a gene-fusion associated cancer. In another embodiment, the invention provides for a method of detecting the presence of an EGFR fusion molecule in a subject. In some embodiments, the method comprises obtaining a sample from the subject to determine whether the subject expresses an EGFR fusion molecule. In some embodiments, the sample is incubated with an agent that binds to an EGFR fusion molecule, such as an antibody, a probe, a nucleic acid primer, and the like. In other embodiments, the detection or determination comprises nucleic acid sequencing, selective hybridization, selective amplification, gene expression analysis, or a combination thereof. In another embodiment, the detection or determination comprises protein expression analysis, for example by western blot analysis, ELISA, or other antibody detection methods. In some embodiments, the method further comprises assessing whether to administer an EGFR fusion molecule inhibitor based on the expression pattern of the subject. In further embodiments, the method comprises administering an EGFR fusion molecule inhibitor to the subject. Altered RNA expression includes the presence of an altered RNA sequence, the presence of an altered RNA splicing or processing, or the presence of an altered quantity of RNA. These can be detected by various techniques known in the art, including sequencing all or part of the RNA or by selective hybridization or selective amplification of all or part of the RNA.

In a further embodiment, the method can comprise detecting the presence or expression of an EGFR fusion molecule, such as a nucleic acid encoding an EGFR-SEPT fusion (such as an EGFR-SEPT14 fusion), an EGFR-CAND fusion (such as an EGFR-CAND1 fusion), or an EGFR-PSPH fusion. Altered polypeptide expression includes the presence of an altered polypeptide sequence, the presence of an altered quantity of polypeptide, or the presence of an altered tissue distribution. These can be detected by various techniques known in the art, including by sequencing and/or binding to specific ligands (such as antibodies). In one embodiment, the detecting comprises using a northern blot; real time PCR and primers directed to SEQ ID NOS: 2, 4, 8, 10, 14, or 15; a ribonuclease protection assay; a hybridization, amplification, or sequencing technique to detect an EGFR fusion molecule, such as one comprising SEQ ID NOS: 2, 4, 8, 10, 14, or 15; or a combination thereof. In another embodiment, the PCR primers comprise SEQ ID NOS 32, 33, 34, 35, 36, 37, 38, 39, 40, 41, 42, 43, 44, 45, 87, 88, or 89. In a further embodiment, primers used for the screening of EGFR fusion molecules, comprise SEQ ID NOS 32, 33, 34, 35, 36, 37, 38, 39, 40, 41, 42, 43, 44, 45, 87, 88, or 89. In some embodiments, primers used for genomic detection of an EGFR fusion comprise SEQ ID NOS 40, 41, 42, 43, 44, 45, or 89.

Various techniques known in the art can be used to detect or quantify altered gene or RNA expression or nucleic acid sequences, which include, but are not limited to, hybridization, sequencing, amplification, and/or binding to specific ligands (such as antibodies). Other suitable methods include allele-specific oligonucleotide (ASO), oligonucleotide ligation, allele-specific amplification, Southern blot (for DNAs), Northern blot (for RNAs), single-stranded conformation analysis (SSCA), PFGE, fluorescent in situ hybridization (FISH), gel migration, clamped denaturing gel electrophoresis, denaturing HLPC, melting curve analysis, heteroduplex analysis, RNase protection, chemical or enzymatic mismatch cleavage, ELISA, radio-immunoassays (RIA) and immuno-enzymatic assays (IEMA).

Some of these approaches (such as SSCA and constant gradient gel electrophoresis (CGGE)) are based on a change in electrophoretic mobility of the nucleic acids, as a result of the presence of an altered sequence. According to these techniques, the altered sequence is visualized by a shift in mobility on gels. The fragments can then be sequenced to confirm the alteration. Some other approaches are based on specific hybridization between nucleic acids from the subject and a probe specific for wild type or altered gene or RNA. The probe can be in suspension or immobilized on a substrate. The probe can be labeled to facilitate detection of hybrids. Some of these approaches are suited for assessing a polypeptide sequence or expression level, such as Northern blot, ELISA and RIA. These latter require the use of a ligand specific for the polypeptide, for example, the use of a specific antibody.

Hybridization.

Hybridization detection methods are based on the formation of specific hybrids between complementary nucleic acid sequences that serve to detect nucleic acid sequence alteration(s). A detection technique involves the use of a nucleic acid probe specific for a wild type or altered gene or RNA, followed by the detection of the presence of a hybrid. The probe can be in suspension or immobilized on a substrate or support (for example, as in nucleic acid array or chips technologies). The probe can be labeled to facilitate detection of hybrids. In one embodiment, the probe according to the invention can comprise a nucleic acid directed to SEQ ID NOS: 2, 4, 8, 10, 14, or 15. For example, a sample from the subject can be contacted with a nucleic acid probe specific for a gene encoding an EGFR fusion molecule, and the formation of a hybrid can be subsequently assessed. In one embodiment, the method comprises contacting simultaneously the sample with a set of probes that are specific for an EGFR fusion molecule. Also, various samples from various subjects can be investigated in parallel.

According to the invention, a probe can be a polynucleotide sequence which is complementary to and specifically hybridizes with a, or a target portion of a, gene or RNA corresponding to an EGFR fusion molecule. Useful probes are those that are complementary to the gene, RNA, or target portion thereof. Probes can comprise single-stranded nucleic acids of between 8 to 1000 nucleotides in length, for instance between 10 and 800, between 15 and 700, or between 20 and 500. Longer probes can be used as well. A useful probe of the invention is a single stranded nucleic acid molecule of between 8 to 500 nucleotides in length, which can specifically hybridize to a region of a gene or RNA that corresponds to an EGFR fusion molecule.

The sequence of the probes can be derived from the sequences of the EGFR fusion genes provided herein. Nucleotide substitutions can be performed, as well as chemical modifications of the probe. Such chemical modifications can be accomplished to increase the stability of hybrids (e.g., intercalating groups) or to label the probe. Some examples of labels include, without limitation, radioactivity, fluorescence, luminescence, and enzymatic labeling.

A guide to the hybridization of nucleic acids is found in e.g., Sambrook, ed., *Molecular Cloning: A Laboratory Manual* (3rd Ed.), Vols. 1-3, Cold Spring Harbor Laboratory, 1989; *Current Protocols In Molecular Biology*, Ausubel, ed. John Wiley & Sons, Inc., New York, 2001; *Laboratory Techniques In Biochemistry And Molecular Biology: Hybridization With Nucleic Acid Probes, Part I. Theory and Nucleic Acid Preparation*, Tijssen, ed. Elsevier, N.Y., 1993.

Sequencing.

Sequencing can be carried out using techniques well known in the art, using automatic sequencers. The sequencing can be performed on the complete EGFR fusion molecule or on specific domains thereof.

Amplification.

Amplification is based on the formation of specific hybrids between complementary nucleic acid sequences that serve to initiate nucleic acid reproduction. Amplification can be performed according to various techniques known in the art, such as by polymerase chain reaction (PCR), ligase chain reaction (LCR), strand displacement amplification (SDA) and nucleic acid sequence based amplification (NASBA). These techniques can be performed using commercially available reagents and protocols. Useful techniques in the art encompass real-time PCR, allele-specific PCR, or PCR based single-strand conformational polymorphism (SSCP). Amplification usually requires the use of specific nucleic acid primers, to initiate the reaction. For example, nucleic acid primers useful for amplifying sequences corresponding to an EGFR fusion molecule are able to specifically hybridize with a portion of the gene locus that flanks a target region of the locus. In one embodiment, amplification comprises using forward and reverse PCR primers directed to SEQ ID NOS: 2, 4, 8, 10, 14, or 15. Nucleic acid primers useful for amplifying sequences from an EGFR fusion molecule; the primers specifically hybridize with a portion of an EGFR fusion molecule. In certain subjects, the presence of an EGFR fusion molecule corresponds to a subject with a gene fusion-associated cancer. In one embodiment, amplification can comprise using forward and reverse PCR primers comprising nucleotide sequences of SEQ ID NOS: 32, 33, 34, 35, 36, 37, 38, 39, 40, 41, 42, 43, 44, 45, 87, 88, or 89.

Non-limiting amplification methods include, e.g., polymerase chain reaction, PCR (*PCR Protocols, A Guide To Methods And Applications*, ed. Innis, Academic Press, N.Y., 1990 and *PCR Strategies,* 1995, ed. Innis, Academic Press, Inc., N.Y.); ligase chain reaction (LCR) (Wu (1989) *Genomics* 4:560; Landegren (1988) *Science* 241:1077; Barringer (1990) *Gene* 89:117); transcription amplification (Kwoh (1989) *PNAS* 86:1173); and, self-sustained sequence replication (Guatelli (1990) *PNAS* 87:1874); Q Beta replicase amplification (Smith (1997) *J. Clin. Microbiol.* 35:1477-1491), automated Q-beta replicase amplification assay (Burg (1996) *Mol. Cell. Probes* 10:257-271) and other RNA polymerase mediated techniques (e.g., NASBA, Cangene, Mississauga, Ontario; see also Berger (1987) *Methods Enzymol.* 152:307-316; U.S. Pat. Nos. 4,683,195 and 4,683,202; and Sooknanan (1995) *Biotechnology* 13:563-564). All the references stated above are incorporated by reference in their entireties.

The invention provides for a nucleic acid primer, wherein the primer can be complementary to and hybridize specifically to a portion of an EGFR fusion molecule, such as a nucleic acid (e.g., DNA or RNA), in certain subjects having a gene fusion-associated cancer. In one embodiment, the gene-fusion associated cancer comprises glioblastoma multiforme, breast cancer, lung cancer, prostate cancer, or colorectal carcinoma. Primers of the invention can be specific for fusion sequences in a nucleic acid (DNA or RNA) encoding an EGFR-SEPT fusion (such as an EGFR-SEPT14 fusion), an EGFR-CAND fusion (such as an EGFR-CAND1 fusion), or an EGFR-PSPH fusion. By using such primers, the detection of an amplification product indicates the presence of a fusion of a nucleic acid encoding an EGFR-SEPT fusion (such as an EGFR-SEPT14 fusion), an EGFR-CAND fusion (such as an EGFR-CAND1 fusion), or an EGFR- PSPH fusion. Examples of primers of this invention can be single-stranded nucleic acid molecules of about 5 to 60 nucleotides in length, or about 8 to about 25 nucleotides in length. The sequence can be derived directly from the sequence of an EGFR fusion molecule, e.g. a nucleic acid encoding an EGFR-SEPT fusion (such as an EGFR-SEPT14 fusion), an EGFR-CAND fusion (such as an EGFR-CAND1 fusion), or an EGFR-PSPH fusion. Perfect complementarity is useful to ensure high specificity; however, certain mismatch can be tolerated. For example, a nucleic acid primer or a pair of nucleic acid primers as described above can be used in a method for detecting the presence of a gene fusion-associated cancer in a subject. In one embodiment, primers can be used to detect an EGFR fusion molecule, such as a primer comprising SEQ ID NOS: 32, 33, 34, 35, 36, 37, 38, 39, 40, 41, 42, 43, 44, 45, 87, 88, 89; or a combination thereof.

Specific Ligand Binding.

As discussed herein, a nucleic acid encoding an EGFR fusion molecule or expression of an EGFR fusion molecule, can also be detected by screening for alteration(s) in a sequence or expression level of a polypeptide encoded by the same. Different types of ligands can be used, such as specific antibodies. In one embodiment, the sample is contacted with an antibody specific for a polypeptide encoded by an EGFR fusion molecule and the formation of an immune complex is subsequently determined. Various methods for detecting an immune complex can be used, such as ELISA, radioimmunoassays (RIA) and immuno-enzymatic assays (IEMA).

For example, an antibody can be a polyclonal antibody, a monoclonal antibody, as well as fragments or derivatives thereof having substantially the same antigen specificity. Fragments include Fab, Fab'2, or CDR regions. Derivatives include single-chain antibodies, humanized antibodies, or poly-functional antibodies. An antibody specific for a polypeptide encoded by an EGFR fusion molecule can be an antibody that selectively binds such a polypeptide. In one embodiment, the antibody is raised against a polypeptide encoded by an EGFR fusion molecule or an epitope-containing fragment thereof. Although non-specific binding towards other antigens can occur, binding to the target polypeptide occurs with a higher affinity and can be reliably discriminated from non-specific binding. In one embodiment, the method can comprise contacting a sample from the subject with an antibody specific for an EGFR fusion molecule, and determining the presence of an immune complex. Optionally, the sample can be contacted to a support coated with antibody specific for an EGFR fusion molecule. In one embodiment, the sample can be contacted simultaneously, or in parallel, or sequentially, with various antibodies specific for different forms of an EGFR fusion molecule, e.g., EGFR-SEPT fusion (such as an EGFR-SEPT14 fusion), an EGFR-CAND fusion (such as an EGFR-CAND1 fusion), or an EGFR-PSPH fusion.

The invention also provides for a diagnostic kit comprising products and reagents for detecting in a sample from a subject the presence of an EGFR fusion molecule. The kit can be useful for determining whether a sample from a subject exhibits reduced expression of an EGFR fusion molecule. For example, the diagnostic kit according to the present invention comprises any primer, any pair of primers, any nucleic acid probe and/or any ligand, or any antibody directed specifically to an EGFR fusion molecule. The diagnostic kit according to the present invention can further comprise reagents and/or protocols for performing a hybridization, amplification, or antigen-antibody immune reaction.

In one embodiment, the kit can comprise nucleic acid primers that specifically hybridize to and can prime a polymerase reaction from an EGFR fusion molecule comprising SEQ ID NOS: 32, 33, 34, 35, 36, 37, 38, 39, 40, 41, 42, 43, 44, 45, 87, 88, 89, or a combination thereof. In one embodiment, primers can be used to detect an EGFR fusion molecule, such as a primer comprising SEQ ID NOS: 32, 33, 34, 35, 36, 37, 38, 39, 40, 41, 42, 43, 44, 45, 87, 88, 89; or a combination thereof. In a further embodiment, primers used for the screening of EGFR fusion molecules.

The diagnosis methods can be performed in vitro, ex vivo, or in vivo. These methods utilize a sample from the subject in order to assess the status of an EGFR fusion molecule. The sample can be any biological sample derived from a subject, which contains nucleic acids or polypeptides. Examples of such samples include, but are not limited to, fluids, tissues, cell samples, organs, and tissue biopsies. Non-limiting examples of samples include blood, liver, plasma, serum, saliva, urine, or seminal fluid. The sample can be collected according to conventional techniques and used directly for diagnosis or stored. The sample can be treated prior to performing the method, in order to render or improve availability of nucleic acids or polypeptides for testing. Treatments include, for instance, lysis (e.g., mechanical, physical, or chemical), centrifugation. The nucleic acids and/or polypeptides can be pre-purified or enriched by conventional techniques, and/or reduced in complexity. Nucleic acids and polypeptides can also be treated with enzymes or other chemical or physical treatments to produce fragments thereof. In one embodiment, the sample is contacted with reagents, such as probes, primers, or ligands, in order to assess the presence of an EGFR fusion molecule. Contacting can be performed in any suitable device, such as a plate, tube, well, or glass. In some embodiments, the contacting is performed on a substrate coated with the reagent, such as a nucleic acid array or a specific ligand array. The substrate can be a solid or semi-solid substrate such as any support comprising glass, plastic, nylon, paper, metal, or polymers. The substrate can be of various forms and sizes, such as a slide, a membrane, a bead, a column, or a gel. The contacting can be made under any condition suitable for a complex to be formed between the reagent and the nucleic acids or polypeptides of the sample.

Nucleic Acid Delivery Methods

Delivery of nucleic acids into viable cells can be effected ex vivo, in situ, or in vivo by use of vectors, such as viral vectors (e.g., lentivirus, adenovirus, adeno-associated virus, or a retrovirus), or ex vivo by use of physical DNA transfer methods (e.g., liposomes or chemical treatments). Non-limiting techniques suitable for the transfer of nucleic acid into mammalian cells in vitro include the use of liposomes, electroporation, microinjection, cell fusion, DEAE-dextran, and the calcium phosphate precipitation method (See, for example, Anderson, *Nature*, 1998) supplement to 392 (6679):25( ). Introduction of a nucleic acid or a gene encoding a polypeptide of the invention can also be accomplished with extrachromosomal substrates (transient expression) or artificial chromosomes (stable expression). Cells can also be cultured ex vivo in the presence of therapeutic compositions of the present invention in order to proliferate or to produce a desired effect on or activity in such cells. Treated cells can then be introduced in vivo for therapeutic purposes.

Nucleic acids can be inserted into vectors and used as gene therapy vectors. A number of viruses have been used as gene transfer vectors, including papovaviruses, e.g., SV40 (Madzak et al., (1992) *J Gen Virol.* 73(Pt 6):1533-6), adenovirus (Berkner (1992) *Curr Top Microbiol Immunol.* 158: 39-66; Berkner (1988) *Biotechniques*, 6(7):616-29; Gorziglia and Kapikian (1992)*J Virol.* 66(7):4407-12; Quantin et al., (1992) *Proc Natl Acad Sci USA.* 89(7):2581-4; Rosenfeld et al., (1992) *Cell.* 68(1):143-55; Wilkinson et al., (1992) *Nucleic Acids Res.* 20(9):2233-9; Stratford-Perricaudet et al., (1990) *Hum Gene Ther.* 1(3):241-56), vaccinia virus (Moss (1992) *Curr Opin Biotechnol.* 3(5):518-22), adeno-associated virus (Muzyczka, (1992) *Curr Top Microbiol Immunol.* 158:97-129; Ohi et al., (1990) *Gene.* 89(2): 279-82), herpesviruses including HSV and EBV (Margolskee (1992) *Curr Top Microbiol Immunol.* 158:67-95; Johnson et al., (1992) *Brain Res Mol Brain Res.*12(1-3):95-102; Fink et al., (1992) *Hum Gene Ther.* 3(1):11-9; Breakefield and Geller (1987) *Mol Neurobiol.* 1(4):339-71; Freese et al., (1990) *Biochem Pharmacol.* 40(10):2189-99), and retroviruses of avian (Bandyopadhyay and Temin (1984) *Mol Cell Biol.* 4(4):749-54; Petropoulos et al., (1992) *J Virol.* 66(6):3391-7), murine (Miller et al. (1992) *Mol Cell Biol.* 12(7):3262-72; Miller et al., (1985) *J Virol.* 55(3):521-6; Sorge et al., (1984) *Mol Cell Biol.* 4(9):1730-7; Mann and Baltimore (1985) *J Virol.* 54(2):401-7; Miller et al., (1988) *J Virol.* 62(11):4337-45), and human origin (Shimada et al., (1991) *J Clin Invest.* 88(3):1043-7; Helseth et al., (1990) *J Virol.* 64(12):6314-8; Page et al., (1990) *J Virol.* 64(11): 5270-6; Buchschacher and Panganiban (1992) *J Virol.* 66(5): 2731-9).

Non-limiting examples of in vivo gene transfer techniques include transfection with viral (e.g., retroviral) vectors (see U.S. Pat. No. 5,252,479, which is incorporated by reference in its entirety) and viral coat protein-liposome mediated transfection (Dzau et al., (1993) *Trends in Biotechnology* 11:205-210), incorporated entirely by reference). For example, naked DNA vaccines are generally known in the art; see Brower, (1998) *Nature Biotechnology,* 16:1304-1305, which is incorporated by reference in its entirety. Gene therapy vectors can be delivered to a subject by, for example, intravenous injection, local administration (see, e.g., U.S. Pat. No. 5,328,470) or by stereotactic injection (see, e.g., Chen, et al., (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

For reviews of nucleic acid delivery protocols and methods see Anderson et al. (1992) *Science* 256:808-813; U.S. Pat. Nos. 5,252,479, 5,747,469, 6,017,524, 6,143,290, 6,410,010 6,511,847; and U.S. Application Publication No. 2002/0077313, which are all hereby incorporated by reference in their entireties. For additional reviews, see Friedmann (1989) *Science,* 244:1275-1281; Verma, *Scientific American:* 68-84 (1990); Miller (1992) *Nature,* 357: 455-460; Kikuchi et al. (2008) *J Dermatol Sci.* 50(2):87-98; Isaka et al. (2007) *Expert Opin Drug Deliv.* 4(5):561-71; Jager et al. (2007) *Curr Gene Ther.* 7(4):272-83; Waehler et al. (2007) *Nat Rev Genet.* 8(8):573-87; Jensen et al. (2007) *Ann Med.* 39(2):108-15; Herweijer et al. (2007) *Gene Ther.* 14(2):99-107; Eliyahu et al. (2005) *Molecules* 10(1):34-64; and Altaras et al. (2005) *Adv Biochem Eng Biotechnol.* 99:193-260, all of which are hereby incorporated by reference in their entireties.

An EGFR fusion nucleic acid can also be delivered in a controlled release system. For example, the EGFR fusion molecule can be administered using intravenous infusion, an implantable osmotic pump, a transdermal patch, liposomes, or other modes of administration. In one embodiment, a pump can be used (see Sefton (1987) *Biomed. Eng.* 14:201; Buchwald et al. (1980) *Surgery* 88:507; Saudek et al. (1989)*N. Engl. J. Med.* 321:574). In another embodiment, polymeric materials can be used (see *Medical Applications of Controlled Release*, Langer and Wise (eds.), CRC Pres., Boca Raton, Fla. (1974); *Controlled Drug Bioavailability, Drug Product Design and Performance*, Smolen and Ball (eds.), Wiley, New York (1984); Ranger and Peppas, (1983) *J. Macromol. Sci. Rev. Macromol. Chem.* 23:61; see also Levy et al. (1985) *Science* 228:190; During et al. (1989) *Ann. Neurol.* 25:351; Howard et al. (1989) *J. Neurosurg.* 71:105). In yet another embodiment, a controlled release system can be placed in proximity of the therapeutic target thus requiring only a fraction of the systemic dose (see, e.g., Goodson, in *Medical Applications of Controlled Release*, supra, vol. 2, pp. 115-138 (1984)). Other controlled release systems are discussed in the review by Langer (*Science* (1990) 249:1527-1533).

Pharmaceutical Compositions and Administration for Therapy

An inhibitor of the invention can be incorporated into pharmaceutical compositions suitable for administration, for example the inhibitor and a pharmaceutically acceptable carrier AN EGFR fusion molecule or inhibitor of the invention can be administered to the subject once (e.g., as a single injection or deposition). Alternatively, an EGFR fusion molecule or inhibitor can be administered once or twice daily to a subject in need thereof for a period of from about two to about twenty-eight days, or from about seven to about ten days. AN EGFR fusion molecule or inhibitor can also be administered once or twice daily to a subject for a period of 1, 2, 3, 4, 5, 6, 7, 8, 9, 10, 11, 12 times per year, or a combination thereof. Furthermore, an EGFR fusion molecule or inhibitor of the invention can be co-administered with another therapeutic. Where a dosage regimen comprises multiple administrations, the effective amount of the EGFR fusion molecule or inhibitor administered to the subject can comprise the total amount of gene product administered over the entire dosage regimen.

AN EGFR fusion molecule or inhibitor can be administered to a subject by any means suitable for delivering the EGFR fusion molecule or inhibitor to cells of the subject, such as cancer cells, e.g., glioblastoma multiforme, breast cancer, lung cancer, prostate cancer, or colorectal carcinoma. For example, an EGFR fusion molecule or inhibitor can be administered by methods suitable to transfect cells. Transfection methods for eukaryotic cells are well known in the art, and include direct injection of the nucleic acid into the nucleus or pronucleus of a cell; electroporation; liposome transfer or transfer mediated by lipophilic materials; receptor mediated nucleic acid delivery, bioballistic or particle acceleration; calcium phosphate precipitation, and transfection mediated by viral vectors.

The compositions of this invention can be formulated and administered to reduce the symptoms associated with a gene fusion-associated cancer, e.g., glioblastoma multiforme, breast cancer, lung cancer, prostate cancer, or colorectal carcinoma, by any means that produces contact of the active ingredient with the agent's site of action in the body of a subject, such as a human or animal (e.g., a dog, cat, or horse). They can be administered by any conventional means available for use in conjunction with pharmaceuticals, either as individual therapeutic active ingredients or in a combination of therapeutic active ingredients. They can be administered alone, but are generally administered with a pharmaceutical carrier selected on the basis of the chosen route of administration and standard pharmaceutical practice.

A therapeutically effective dose of EGFR fusion molecule or inhibitor can depend upon a number of factors known to those or ordinary skill in the art. The dose(s) of the EGFR fusion molecule inhibitor can vary, for example, depending upon the identity, size, and condition of the subject or sample being treated, further depending upon the route by which the composition is to be administered, if applicable, and the effect which the practitioner desires the an EGFR fusion molecule inhibitor to have upon the nucleic acid or polypeptide of the invention. These amounts can be readily determined by a skilled artisan. Any of the therapeutic applications described herein can be applied to any subject in need of such therapy, including, for example, a mammal such as a dog, a cat, a cow, a horse, a rabbit, a monkey, a pig, a sheep, a goat, or a human.

Pharmaceutical compositions for use in accordance with the invention can be formulated in conventional manner using one or more physiologically acceptable carriers or excipients. The therapeutic compositions of the invention can be formulated for a variety of routes of administration, including systemic and topical or localized administration. Techniques and formulations generally can be found in *Remmington's Pharmaceutical Sciences*, Meade Publishing Co., Easton, Pa. (20th Ed., 2000), the entire disclosure of which is herein incorporated by reference. For systemic administration, an injection is useful, including intramuscular, intravenous, intraperitoneal, and subcutaneous. For injection, the therapeutic compositions of the invention can be formulated in liquid solutions, for example in physiologically compatible buffers such as Hank's solution or Ringer's solution. In addition, the therapeutic compositions can be formulated in solid form and redissolved or suspended immediately prior to use. Lyophilized forms are also included. Pharmaceutical compositions of the present invention are characterized as being at least sterile and pyrogen-free. These pharmaceutical formulations include formulations for human and veterinary use.

According to the invention, a pharmaceutically acceptable carrier can comprise any and all solvents, dispersion media, coatings, antibacterial and antifungal agents, isotonic and absorption delaying agents, and the like, compatible with pharmaceutical administration. The use of such media and agents for pharmaceutically active substances is well known in the art. Any conventional media or agent that is compatible with the active compound can be used. Supplementary active compounds can also be incorporated into the compositions.

A pharmaceutical composition containing EGFR fusion molecule inhibitor can be administered in conjunction with a pharmaceutically acceptable carrier, for any of the therapeutic effects discussed herein. Such pharmaceutical compositions can comprise, for example antibodies directed to an EGFR fusion molecule, or a variant thereof, or antagonists of an EGFR fusion molecule. The compositions can be administered alone or in combination with at least one other agent, such as a stabilizing compound, which can be administered in any sterile, biocompatible pharmaceutical carrier including, but not limited to, saline, buffered saline, dextrose, and water. The compositions can be administered to a patient alone, or in combination with other agents, drugs or hormones.

Sterile injectable solutions can be prepared by incorporating the EGFR fusion molecule inhibitor (e.g., a polypeptide or antibody) in the required amount in an appropriate solvent with one or a combination of ingredients enumerated herein, as required, followed by filtered sterilization. Generally, dispersions are prepared by incorporating the active compound into a sterile vehicle which contains a basic dispersion medium and the required other ingredients from those enumerated herein. In the case of sterile powders for the preparation of sterile injectable solutions, examples of useful preparation methods are vacuum drying and freeze-drying which yields a powder of the active ingredient plus any additional desired ingredient from a previously sterile-filtered solution thereof.

In some embodiments, the EGFR fusion molecule inhibitor can be applied via transdermal delivery systems, which slowly releases the active compound for percutaneous absorption. Permeation enhancers can be used to facilitate transdermal penetration of the active factors in the conditioned media. Transdermal patches are described in for example, U.S. Pat. No. 5,407,713; U.S. Pat. No. 5,352,456; U.S. Pat. No. 5,332,213; U.S. Pat. No. 5,336,168; U.S. Pat. No. 5,290,561; U.S. Pat. No. 5,254,346; U.S. Pat. No. 5,164,189; U.S. Pat. No. 5,163,899; U.S. Pat. No. 5,088,977; U.S. Pat. No. 5,087,240; U.S. Pat. No. 5,008,110; and U.S. Pat. No. 4,921,475.

"Subcutaneous" administration can refer to administration just beneath the skin (i.e., beneath the dermis). Generally, the subcutaneous tissue is a layer of fat and connective tissue that houses larger blood vessels and nerves. The size of this layer varies throughout the body and from person to person. The interface between the subcutaneous and muscle layers can be encompassed by subcutaneous administration. This mode of administration can be feasible where the subcutaneous layer is sufficiently thin so that the factors present in the compositions can migrate or diffuse from the locus of administration. Thus, where intradermal administration is utilized, the bolus of composition administered is localized proximate to the subcutaneous layer.

Administration of the cell aggregates (such as DP or DS aggregates) is not restricted to a single route, but can encompass administration by multiple routes. For instance, exemplary administrations by multiple routes include, among others, a combination of intradermal and intramuscular administration, or intradermal and subcutaneous administration. Multiple administrations can be sequential or concurrent. Other modes of application by multiple routes will be apparent to the skilled artisan.

In other embodiments, this implantation method will be a one-time treatment for some subjects. In further embodiments of the invention, multiple cell therapy implantations will be required. In some embodiments, the cells used for implantation will generally be subject-specific genetically engineered cells. In another embodiment, cells obtained from a different species or another individual of the same species can be used. Thus, using such cells can require administering an immunosuppressant to prevent rejection of the implanted cells. Such methods have also been described in U.S. Pat. No. 7,419,661 and PCT application publication WO 2001/32840, and are hereby incorporated by reference.

A pharmaceutical composition of the invention is formulated to be compatible with its intended route of administration. Examples of routes of administration include parenteral, e.g., intravenous, intradermal, subcutaneous, oral (e.g., inhalation or ingestion), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, a pharmaceutically acceptable polyol like glycerol, propylene glycol, liquid polyetheylene glycol, and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it can be useful to include isotonic agents, for example, sugars, polyalcohols such as mannitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the inhibitor (e.g., a polypeptide or antibody or small molecule) of the invention in the required amount in an appropriate solvent with one or a combination of ingredients enumerated herein, as required, followed by filtered sterilization. Generally, dispersions are prepared by incorporating the active compound into a sterile vehicle which contains a basic dispersion medium and the required other ingredients from those enumerated herein. In the case of sterile powders for the preparation of sterile injectable solutions, examples of useful preparation methods are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier and subsequently swallowed.

Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or sterotes; a glidant such as colloidal silicon dioxide; a sweetening agent such as sucrose or saccharin; or a flavoring agent such as peppermint, methyl salicylate, or orange flavoring.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

In some embodiments, the effective amount of the administered EGFR fusion molecule inhibitor is at least about 0.0001 µg/kg body weight, at least about 0.00025 µg/kg body weight, at least about 0.0005 µg/kg body weight, at least about 0.00075 µg/kg body weight, at least about 0.001 µg/kg body weight, at least about 0.0025 µg/kg body weight, at least about 0.005 µg/kg body weight, at least about 0.0075 µg/kg body weight, at least about 0.01 µg/kg body weight, at least about 0.025 µg/kg body weight, at least about 0.05 µg/kg body weight, at least about 0.075 µg/kg body weight, at least about 0.1 µg/kg body weight, at least about 0.25 µg/kg body weight, at least about 0.5 µg/kg body weight, at least about 0.75 µg/kg body weight, at least about 1 µg/kg body weight, at least about 5 µg/kg body weight, at least about 10 µg/kg body weight, at least about 25 µg/kg body weight, at least about 50 µg/kg body weight, at least about 75 µg/kg body weight, at least about 100 µg/kg body weight, at least about 150 µg/kg body weight, at least about 200 µg/kg body weight, at least about 250 µg/kg body weight, at least about 300 µg/kg body weight, at least about 350 µg/kg body weight, at least about 400 µg/kg body weight, at least about 450 µg/kg body weight, at least about 500 µg/kg body weight, at least about 550 µg/kg body weight, at least about 600 µg/kg body weight, at least about 650 µg/kg body weight, at least about 700 µg/kg body weight, at least about 750 µg/kg body weight, at least about 800 µg/kg body weight, at least about 850 µg/kg body weight, at least about 900 µg/kg body weight, at least about 950 µg/kg body weight, at least about 1000 µg/kg body weight, at least about 2000 µg/kg body weight, at least about 3000 µg/kg body weight, at least about 4000 µg/kg body weight, at least about 5000 µg/kg body weight, at least about 6000 µg/kg body weight, at least about 7000 µg/kg body weight, at least about 8000 µg/kg body weight, at least about 9500 µg/kg body weight, or at least about 10,000 µg/kg body weight.

Unless otherwise defined, all technical and scientific terms used herein have the same meaning as commonly understood by one of ordinary skill in the art to which this invention belongs. Exemplary methods and materials are described below, although methods and materials similar or equivalent to those described herein can also be used in the practice or testing of the present invention.

All publications and other references mentioned herein are incorporated by reference in their entirety, as if each individual publication or reference were specifically and individually indicated to be incorporated by reference. Publications and references cited herein are not admitted to be prior art.

EXAMPLES

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only, since alternative methods can be utilized to obtain similar results.

Example 1: The Integrated Landscape of Driver Genomic Alterations in Glioblastoma To address the challenge of driver mutations in glioblastoma (GBM) and uncover new driver genes in human GBM, a computational platform was developed that integrates the analysis of copy number variations and somatic mutations from a whole-exome dataset. The full spectrum of in-frame gene fusions was unveiled from a large transcriptome dataset of glioblastoma. The analyses revealed focal copy number variations and mutations in all the genes previously implicated in glioblastoma pathogenesis. Recurrent copy number variations and somatic mutations were detected in 18 genes not yet implicated in glioblastoma. For each of the new genes, the occurrence of focal and recurrent copy number changes in addition to somatic mutations underscores the relevance for glioblastoma pathogenesis. Without being bound by theory, mutations in LZTR-1, a Keltch-BTB-BACK-BTB-BACK adaptor of Cul3-containing E3 ligase complexes impacted ubiquitination of LZTR-1 substrates. Loss-of-function mutations of CTNND2 (coding for δ-catenin) targeted a neural-specific gene and were associated with the transformation of glioma cells along the mesenchymal lineage, a hallmark of aggressive glioblastoma. Reconstitution of δ-catenin in mesenchymal glioma cells reprogrammed them towards a neuronal cell fate. Recurrent translocations were also identified that fuse in-frame the coding sequence of EGFR to several partners in 7.6% of tumors, with EGFR-Septin-14 scoring as the most frequent functional gene fusion in human glioblastoma. EGFR fusions enhance proliferation and motility of glioma cells and confer sensitivity to EGFR inhibition in glioblastoma xenografts. These results provide important insights into the pathogenesis of glioblastoma and highlight new targets for therapeutic intervention.

Glioblastoma (GBM) is the most common primary intrinsic malignant brain tumor affecting ~10,000 new patients each year with a median survival rate of only 12-15 months[1,2]. Identifying and understanding the functional significance of the genetic alterations that drive initiation and progression of GBM is crucial to develop more effective therapies. Previous efforts in GBM genome characterization included array-based profiling of copy number changes, methylation and gene expression and targeted sequencing of candidate genes[3-6]. These studies identified somatic changes in well-known GBM genes (EGFR, PTEN, IDH1, TP53, NF1, etc.) and nominated putative cancer genes with somatic mutations, but the functional consequences of most alterations is unknown. The lack of strict correlation between somatic alterations and functionality in GBM is manifested by regions of large copy number variations (CNVs), in which the relevant gene(s) are masked within genomic domains encompassing many other genes. Furthermore, although the potential of next-generation sequencing of the whole coding exome is widely recognized for the nomination of new cancer genes, the elevated somatic mutation rate of GBM is a significant challenge for statistical approaches aimed to distinguish genes harboring driver from those with passenger mutations. A statistical approach was used to nominate driver genes in GBM from the integration of whole-exome sequencing data calling for somatic mutations with a CNVs analysis that prioritizes focality and magnitude of the genetic alterations.

Chromosomal rearrangements resulting in recurrent and oncogenic gene fusions are hallmarks of hematological malignancies and recently they have also been uncovered in solid tumors (breast, prostate, lung and colorectal carcinoma)[7,8]. Recently, a small subset of GBM harbor FGFR-TACC gene fusions were provided indicating that the patients with FGFR-TA CC-positive tumors would benefit from targeted EGFR kinase inhibition[9]. It remains unknown whether gene fusions involving other RTK-coding genes exist in GBM to create different oncogene addicting states. A large RNA-sequencing dataset of primary GBM and glioma stem cells (GSCs) was analyzed and the global landscape of in-frame gene fusions in human GBM was reported.

Nomination of Candidate GBM Genes

Focal CNVs and point mutations provide exquisite information on candidate driver genes by pinpointing their exact location. Without being bound by theory, the integration of somatic point mutations and focal CNV information in a single framework will nominate candidate genes implicated in GBM. MutComFocal is an algorithm designed for this purpose, in which driver genes are ranked by an integrated recurrence, focality and mutation score (see Methods). Overall, this strategy was applied to a cohort of 139 GBM and matched normal DNA analyzed by whole exome sequencing to identify somatic mutations and 469 GBM were analyzed by the Affymetrix SNP6.0 platform to identify CNVs.

Figure 6:
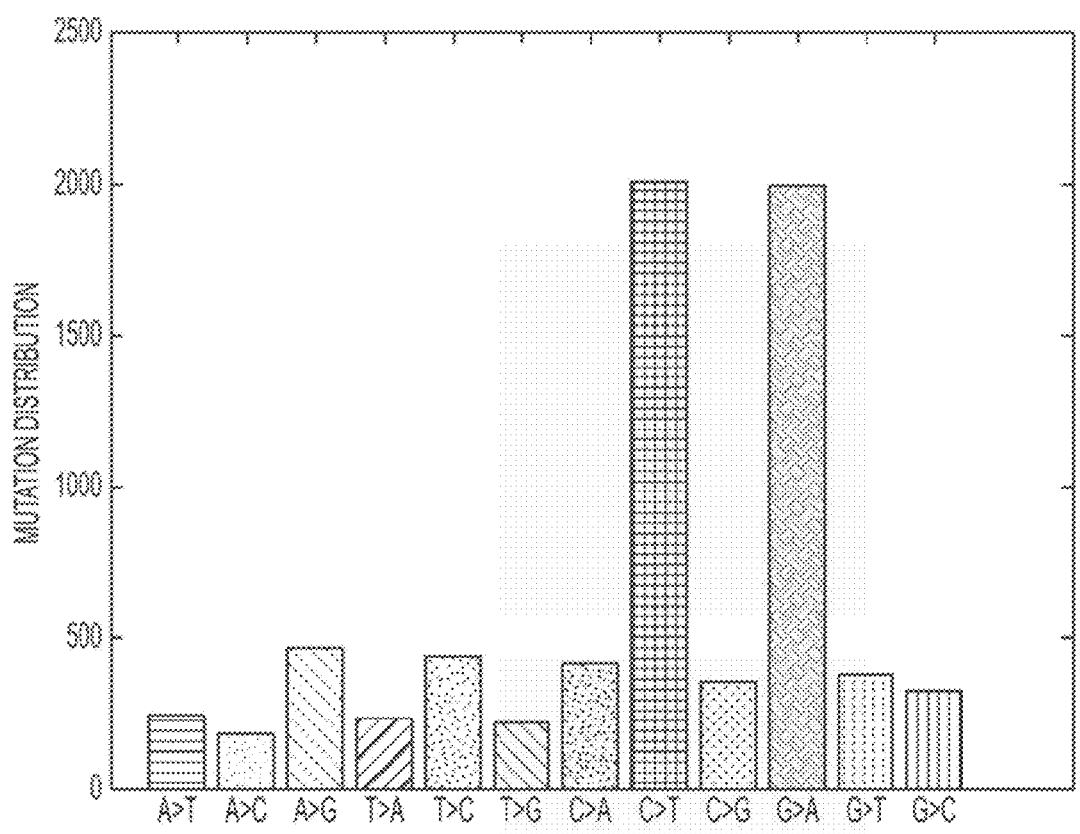
FIG. 6 shows the distribution of substitutions from whole exome data.
Figure 7:
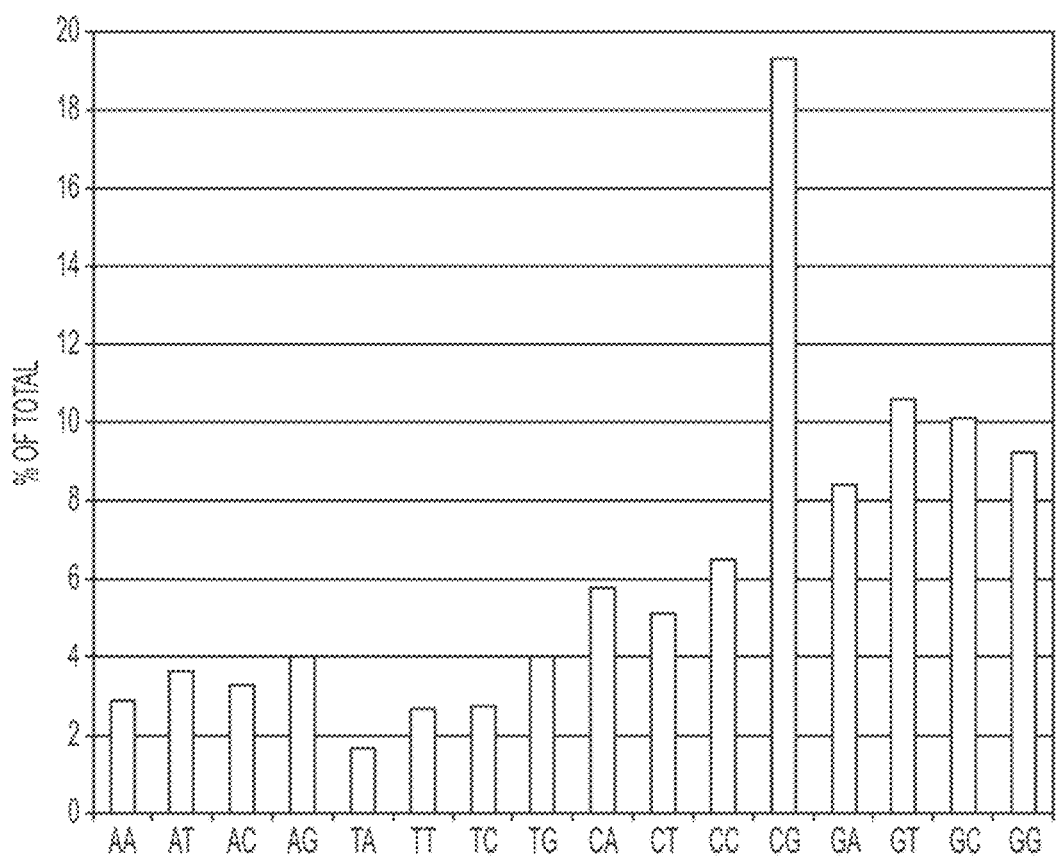
FIG. 7. shows dinucleotide distribution in mutated sites.
Figure 9:
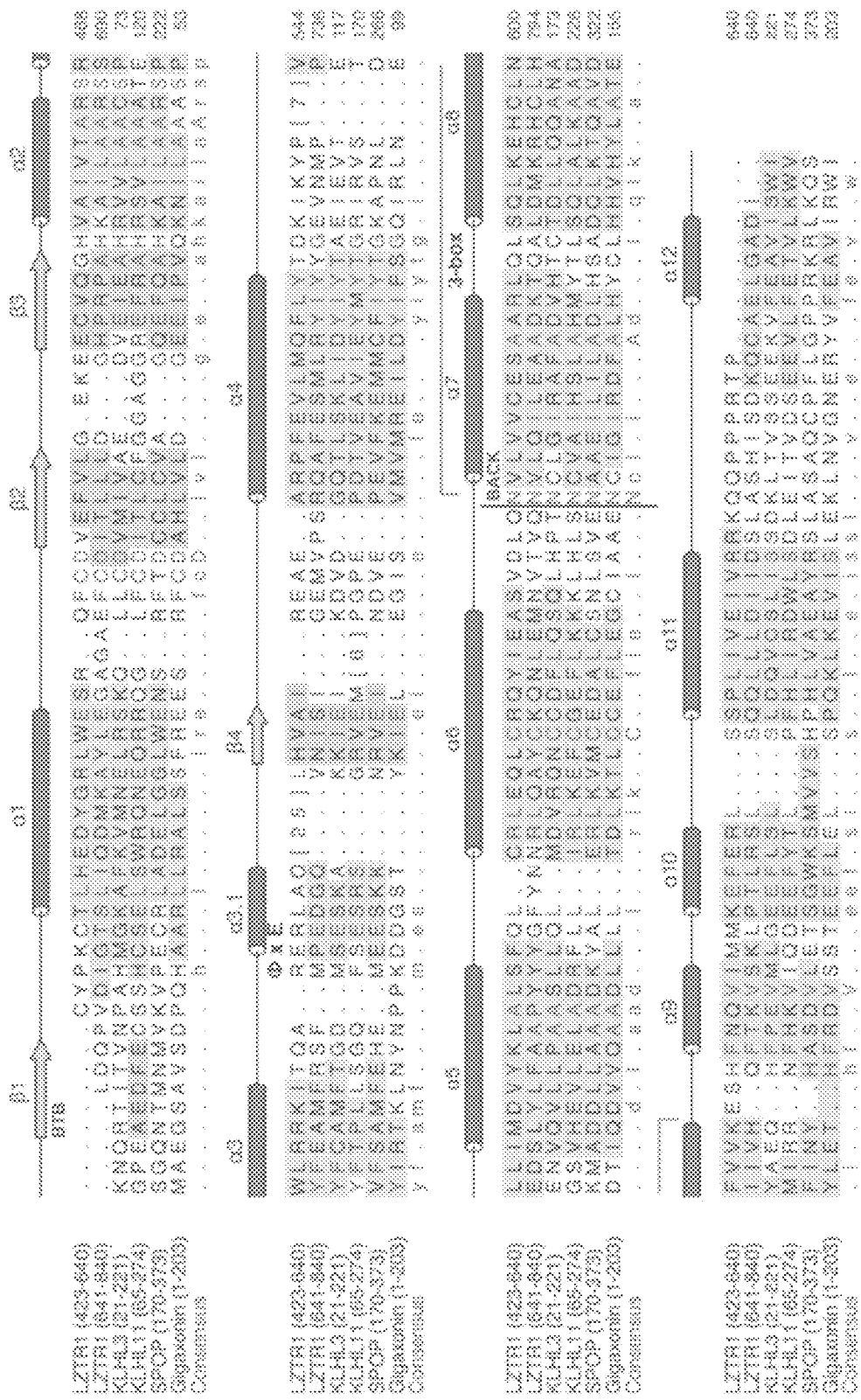
FIG. 9. Sequence alignment of BTB-BACK domains. The two BTB-BACK domains of LZTR-1 are included along with the predicted secondary structure from HHpred[6]. The 3-box is the Cul3 binding element within the BACK domain. The secondary structure of KLHL3 (PDB ID 4HXI), KLHL11 (PDB ID 4AP2) and Gigaxonin (PDB ID 3HVE) are based on the crystal structures. The secondary structure of SPOP is based on a crystal structure for the BTB and 3-box region (PDB ID 3HTM) and HHpred predictions from the remainder of the BACK domain. Only the N-terminal half of the BACK domain from KLHL3, KLHL11 and Gigaxonin is included, as SPOP and LZTR-1 contain truncated versions of the BACK domain. Figure discloses SEQ ID NOS 8483-8488, respectively, in order of appearance.

The whole-exome analysis identified a mean of 43 protein-changing somatic mutations per tumor sample. The distribution of substitutions shows a higher rate of transitions vs tranversions (67%), with a strong preference for C→T and G→A (55%) (FIG. 6). As seen in other tumor types[10], 19.2% of the mutations occurred in a CpG dinucleotide context (FIG. 7). Among somatic small nucleotide variants, the most frequently mutated genes have well-established roles in cancer, including GBM (TP53, EGFR, PTEN, and IDH1). In addition to known cancer genes, whole-exome sequencing identified several potentially new candidate driver genes mutated in ~5% of tumor samples. To uncover the most likely driver genes of GBM initiation and/or progression, the mutation results were integrated with common focal genomic alterations, detected using an algorithm applied to high-density SNP arrays to generate MutComFocal scores. This analysis stratified somatically mutated genes into three groups: recurrently mutated genes without significant copy number alterations (Mut), mutated genes in regions of focal and recurrent amplifications (Amp-Mut) and mutated genes in regions of focal and recurrent deletions (Del-Mut). Employing this framework, a list of 67 genes was generated that score at the top of each of the three categories and that included nearly all the genes previously implicated in GBM. These genes, which are labeled in green in FIG. 1 include IDH1 (Mut, FIG. 1a), PIK3C2B, MDM4, MYCN, PIK3CA, PDGFRA, KIT, EGFR, and BRAF (Amp-Mut, FIG. 1b) and PIK3R1, PTEN, RB1, TP53, NF1 and ATRX (Del-Mut, FIG. 1c). Interestingly, the analysis also selected 52 new candidate driver genes previously unreported in GBM. Based upon their role in development and homeostasis of the CNS and their potential function in oncogenesis and tumor progression, 24 genes were selected for re-sequencing in an independent dataset of 35 GBM and matched normal controls. Eighteen genes were found somatically mutated by Sanger sequencing in the independent panel and are labeled in red in FIG. 1. Each of the validated new GBM genes is targeted by somatic mutations and CNVs in a cumulative fraction comprised between 2.9% and 45.7% of GBM (FIG. 9).

Figure 1B:
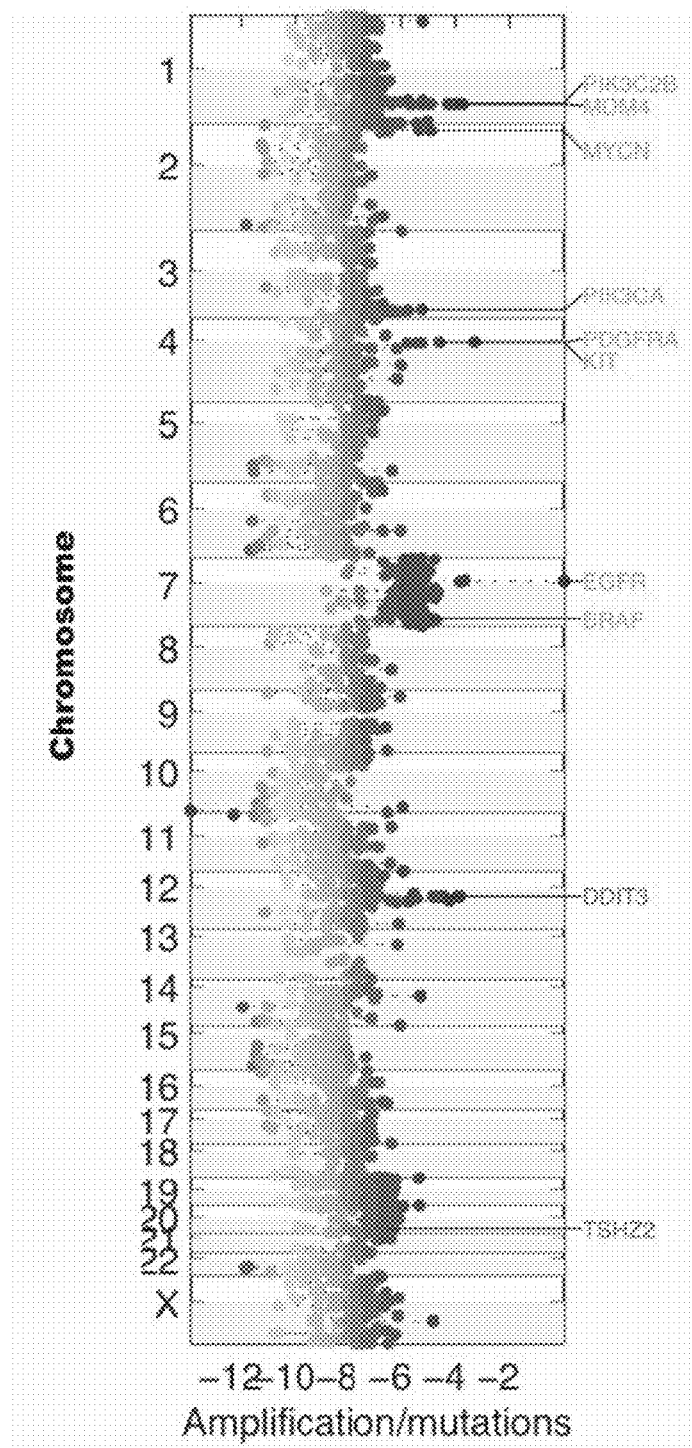
FIG. 1B is a chromosome view of validated GBM genes scoring at the top of each of the three categories by MutComFocal. The plot shows mutated genes in regions of focal and recurrent amplifications (Amp-Mut, Amplification/mutation scores). Previously known GBM genes are indicated in green (light grey in black and white image), new and independently validated GBM genes are indicated in red (dark grey in black and white image).

Among the commonly mutated and focally deleted genes that exhibited top MutComFocal scores and were validated in the independent GBM dataset, BCOR, LRP family members, HERC2, LZTR-1 and CTNND2. BCOR, a chromosome X-linked gene, encodes for a component of the nuclear co-repressor complex that is essential for normal development of the neuroectoderm and stem cell functions[11-13]. BCOR mutations have recently been described in retinoblastoma and medulloblastoma, thus indicating that loss-of-function mutations in BCOR are common genetic events in neuroectodermal tumors[14,15]. LRP1B is a member of the LDL receptor family and is among the most frequently mutated genes in human cancer (FIG. 1c)[16]. Interestingly, two other LDL receptor family members (LRP2 and LRP1) are mutated in 4.4% and 2.9% of tumors, respectively (FIG. 1a). The LRP proteins are highly expressed in the neuroepithelium and are essential for morphogenesis of the forebrain in mouse and humans[17,18]. The tumor suppressor function of LRP proteins in GBM may be linked to their ability to promote chemosensitivity and control signaling through the Sonic hedgehog pathway, which is responsible for maintenance of cancer initiating cells in GBM[19-21]. The gene coding for the Hect ubiquitin ligase Herc2 is localized on chromosome 15q13 and is deleted and mutated in 15.1% and 2.2% of GBM cases, respectively. This gene has been implicated in severe neurodevelopmental syndromes. Moreover, protein substrates of Herc2 are crucial factors in genome stability and DNA damage-repair, two cell functions frequently disrupted in cancer[22,23].

Loss-of-Function Genetic Alterations Target the LZTR-1 and CTNND2 Genes in GBM

Figure 1C:
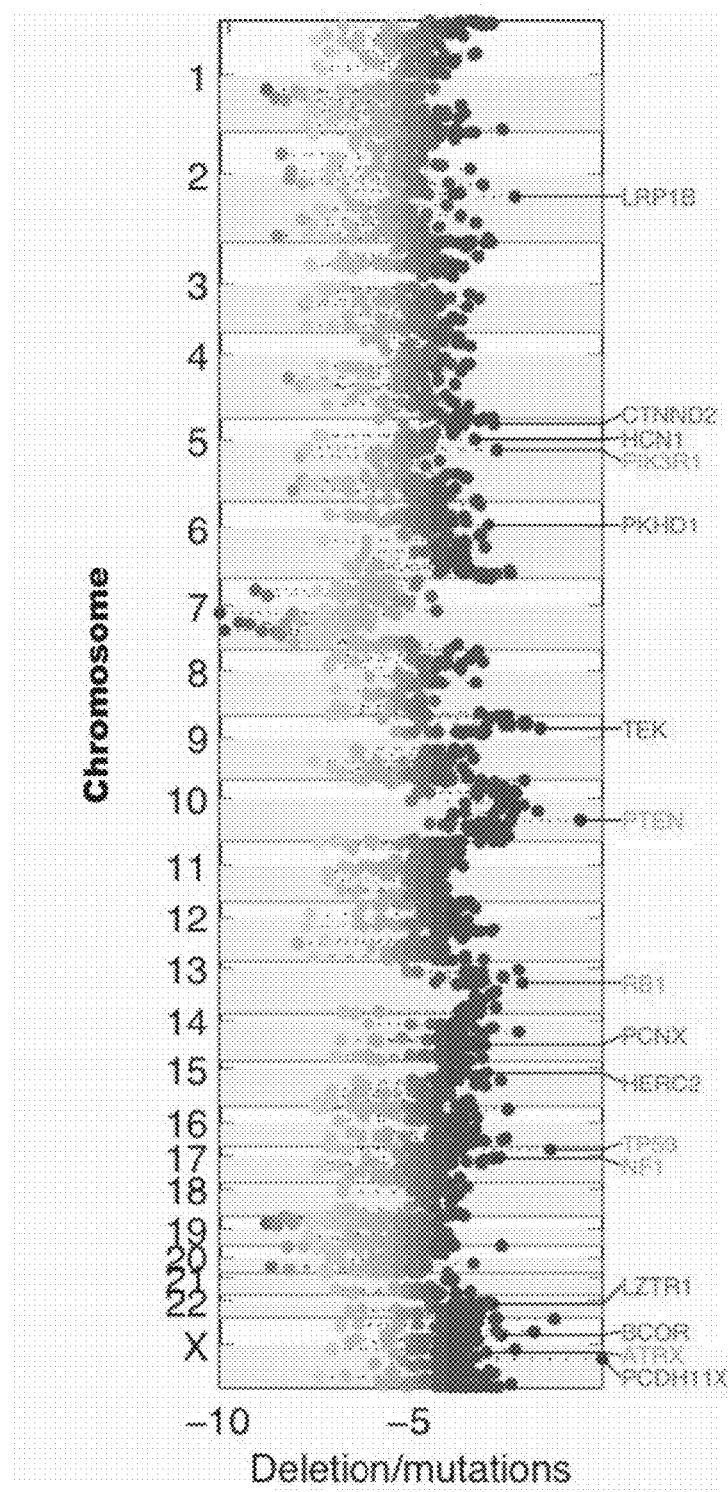
FIG. 1C is a chromosome view of validated GBM genes scoring at the top of each of the three categories by Mut-ComFocal. The plot shows mutated genes in regions of focal and recurrent deletions (Del-Mut, Deletion/mutation scores). Previously known GBM genes are indicated in green (light grey in black and white image), new and independently validated GBM genes are indicated in red (dark grey in black and white image).
Figure 2A:
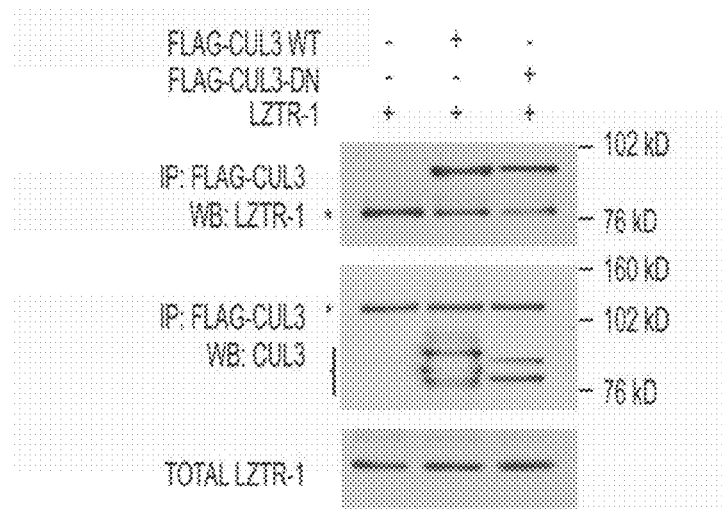
FIGS. 2A-B shows Localization of altered residues in LZTR-1.
Figure 8:
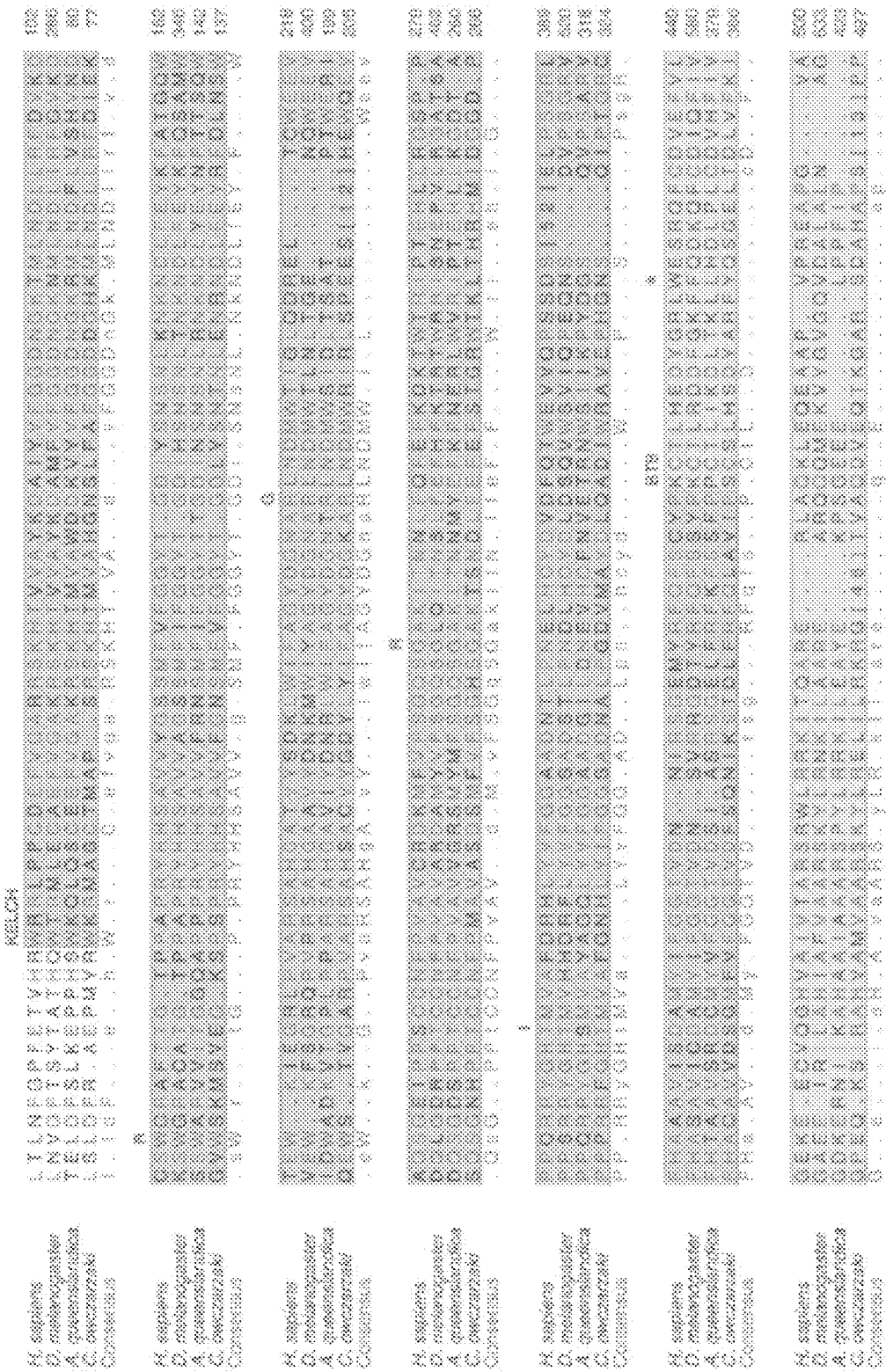
FIG. 8. Sequence alignment of selected LZTR-1 orthologs. Mutations detected in GBM are indicated in red above of the aligned sequences. The LZTR-1 gene is present in most metazoans, including the sponge *Amphimedon queenslandica*, which is generally recognized as the most ancient surviving metazoan lineage[17]. LZTR-1 is also present in some near-metazoan unicellular protists, including *Capsaspora owczarzaki* (included in the Figure) and the choanoflagellates *Salpingoeca rosetta* and *Monosiga brevicollis*. These opisthokonts are key organisms for the study of the evolution of multicellularity, differentiation and cell-cell communication in animals and help in our understanding of the role of molecular pathways in cancer[18]. LZTR-1 has a characteristic Kelch-BTB-BACK-BTB-BACK domain architecture, and unlike the BTB-BACK-Kelch proteins[8], there has been little, if any, duplication of the LZTR-1 gene since its appearance. Despite its name, LZTR-1 does not contain a leucine zipper region. Figure discloses SEQ ID NOS 8479-8482, respectively, in order of appearace.
Figure 8:
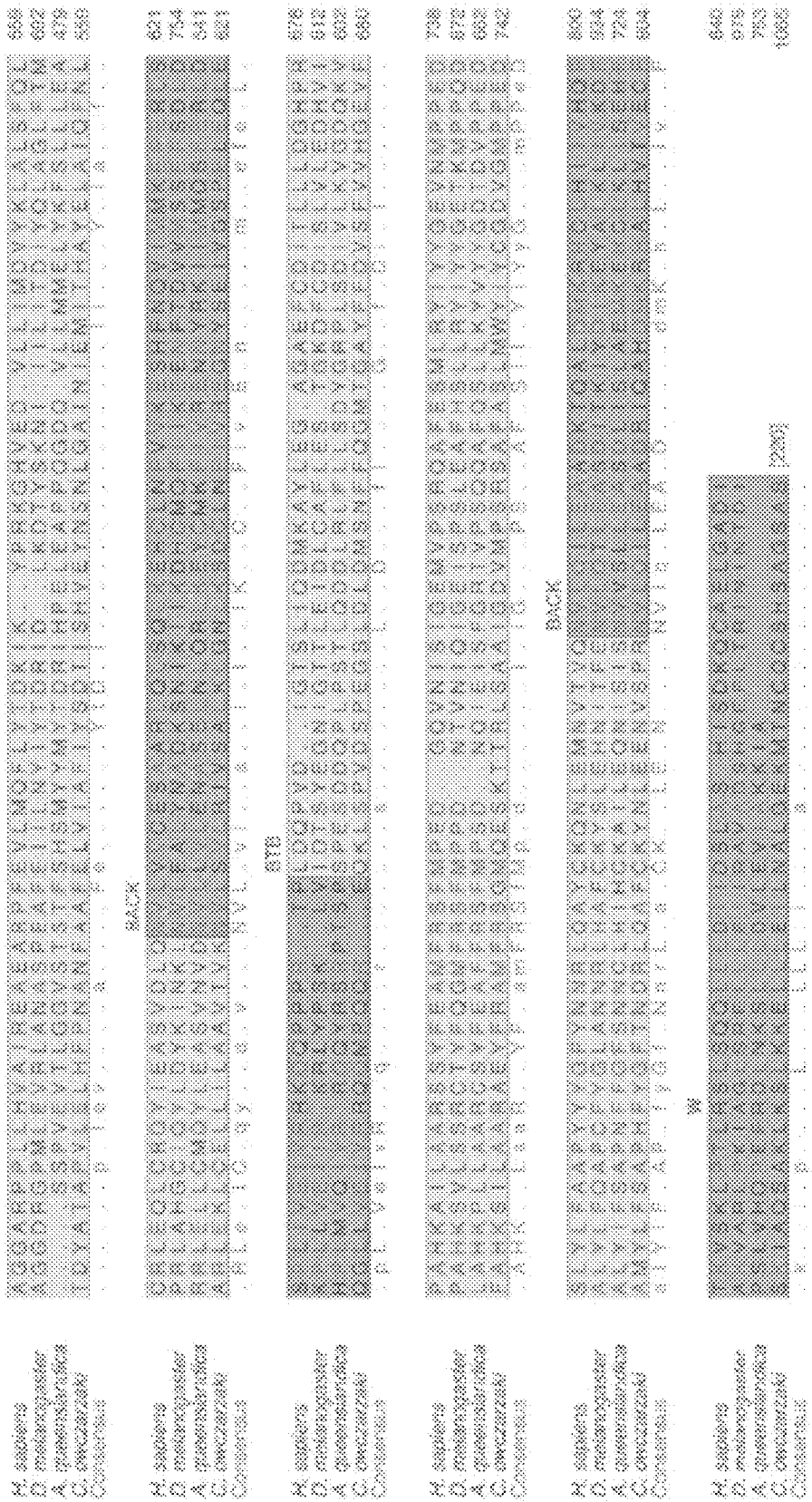

A gene that received one of the highest Del-Mut score by MutComFocal is LZTR-1 (FIG. 1c). The LZTR-1 coding region had non-synonymous mutations in 4.4% and the LZTR-1 locus (human chromosome 22q11) was deleted in 22.4% of GBM. LZTR-1, which is normally expressed in the human brain, codes for a protein with a characteristic Kelch-BTB-BACK-BTB-BACK domain architecture (FIGS. 8, 9). The LZTR-1 gene is highly conserved in the metazoans and was initially proposed to function as a transcriptional regulator, but follow-up studies have excluded a transcriptional role for this protein[24]. Most proteins with BTB-BACK domains are substrate adaptors in Cullin3 (Cul3) ubiquitin ligase complexes, in which the BTB-BACK region binds to the N-terminal domain of Cul3, while a ligand binding domain, often a Kelch 6-bladed β-propeller motif, binds to substrates targeted for ubiquitination[25]. To ask whether LZTR-1 directly binds Cul3, co-immunoprecipitation experiments were performed. FIG. 2a shows that Cul3 immunoprecipitates contain LZTR-1, thus indicating that LZTR-1 is an adaptor in Cul3 ubiquitin ligase complexes.

Figure 2B:
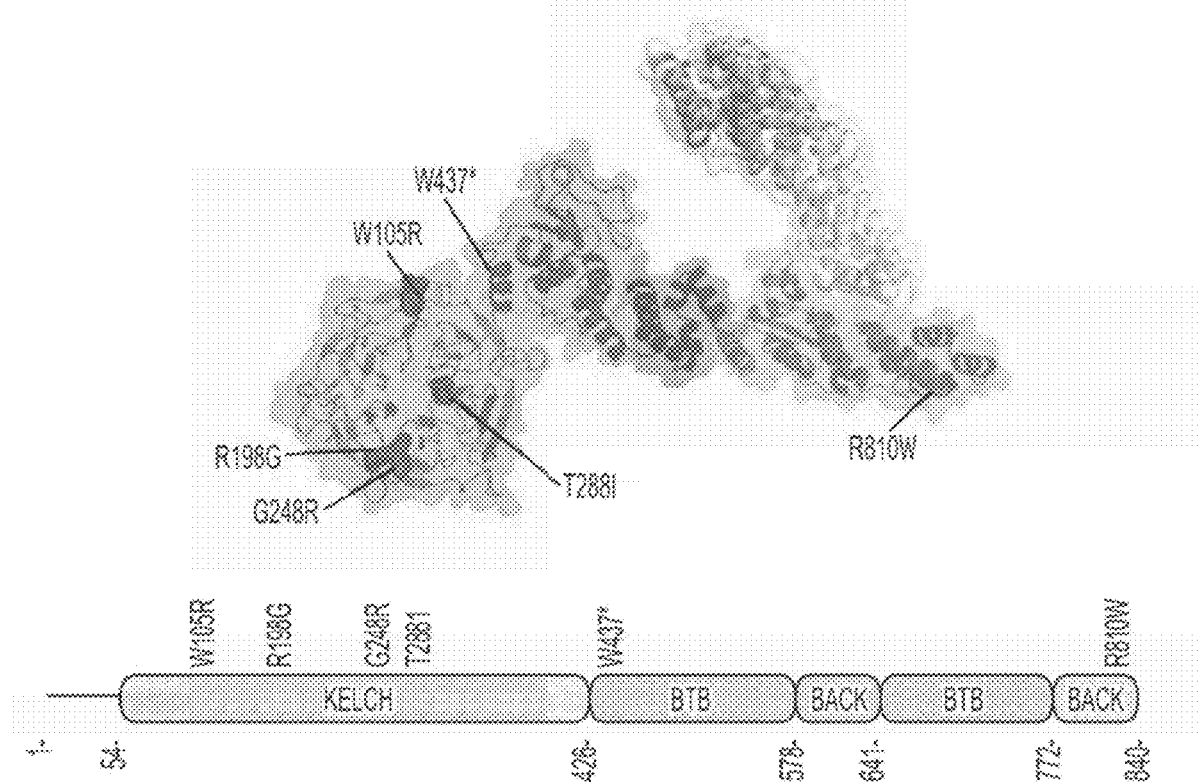

To address the potential function of LZTR-1 mutants, a homology model of LZTR-1 was built based in part on the crystal structures of the MATH-BTB-BACK protein SPOP[26], the BTB-BACK-Kelch proteins KLHL3 and KLHL11[27], and the Kelch domain of Keap1[28] (FIG. 2b). Without being bound by theory, the second BTB-BACK region of LZTR-1 binds Cul3 because of the presence of a φ-X-E motif in this BTB domain, followed by a 3-Box/BACK region (FIG. 9)[26]. However, the preceding BTB-BACK region also participates in Cul3 binding. Four of the six LZTR-1 mutations identified in GBM are located within the Kelch domain and target highly conserved amino acids (FIG. 2b, c, FIG. 8). Interestingly, the concentration of LZTR-1 mutations in the Kelch domain reflects a similar pattern of mutations in the Kelch-coding region of the KLHL3 gene, recently identified in families with hypertension and electrolytic abnormalities[29,30]. The R198G and G248R mutations localize to the b-c loop of the Kelch domain, in a region predicted to provide the substrate-binding surface of the domain[28]. The W105R mutation targets a highly conserved anchor residue in the Ketch repeats and the T288I mutation disrupts a buried residue that is conserved in LZTR-1 (FIG. 2b, FIG. 8). Both of these mutations are expected to perturb the folding of the Kelch domain. The remaining two mutations, located in the BTB-BACK domains are predicted to affect the interaction with Cul3 either by removing the entire BTB-BACK-BTB-BACK region (W437STOP) or by disrupting the folding of the last helical hairpin in the BTB-BACK domain (R810W, FIG. 2b). The pattern of mutations of LZTR-1 in GBM indicates that they impair binding either to specific substrates or to Cul3.

Figure 10B:
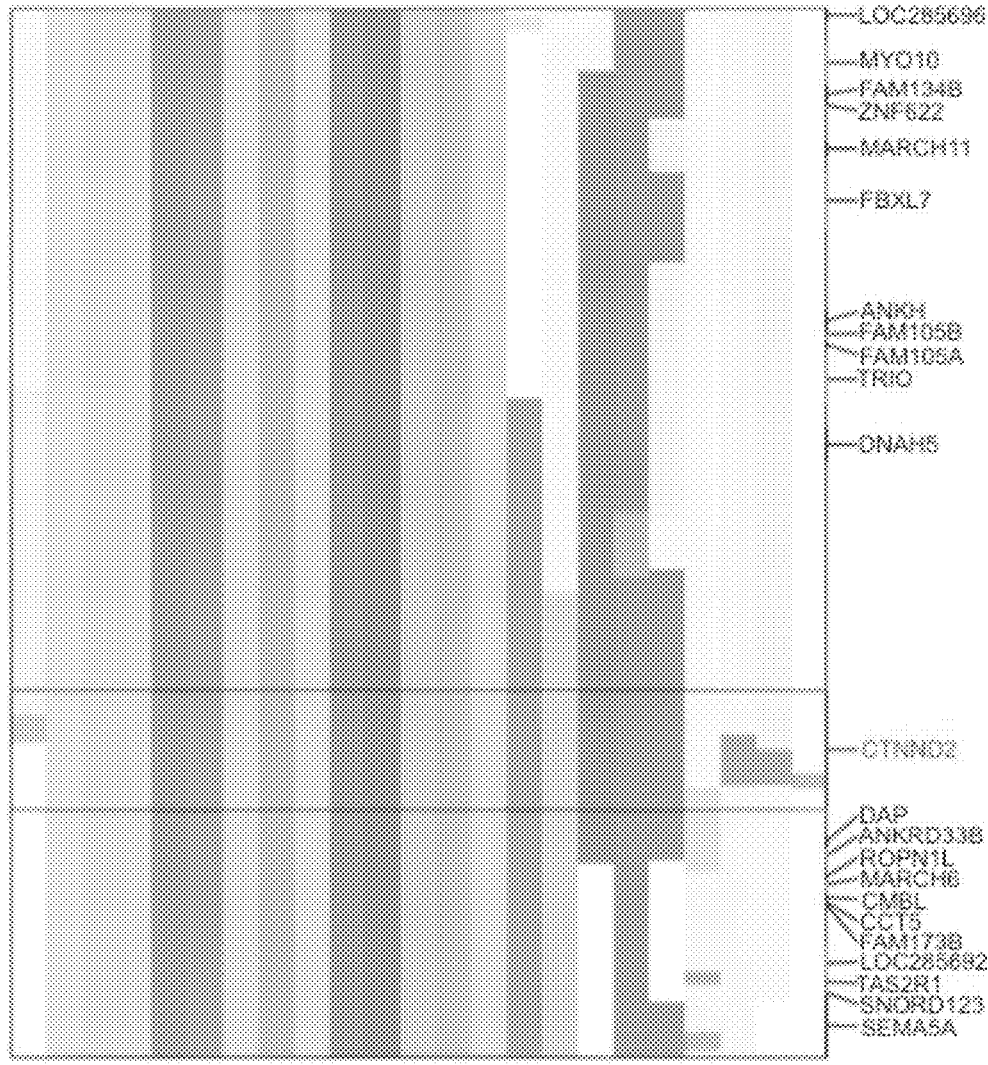
FIG. 10B. Pattern of somatic mutations, CNVs and expression of CTNND2 in GBM. Somatic deletions of CTNND2. Samples are sorted according to the focality of CTNND2 deletion. In the red-blue scale, white corresponds to normal (diploid) copy number, blue is deletion and red is gain.

Among the top ranking genes in MutComFocal, CTNND2 is the gene expressed at the highest levels in the normal brain. CTNND2 codes for □-catenin, a member of the p120 subfamily of catenins that is expressed almost exclusively in the nervous system where it is crucial for neurite elongation, dendritic morphogenesis and synaptic plasticity[31-33]. Germ-line hemizygous loss of CTNND2 severely impairs cognitive function and underlies some forms of mental retardation[34,35]. CTNND2 shows a pronounced clustering of mutations in GBM. The observed spectrum of mutations includes four mutations located in the armadillo-coding domain and one in the region coding for the N-terminal coiled-coil domain (FIG. 10a). These regions are the two most relevant functional domains of S-catenin and each of the mutations targets highly conserved residues with probably (K629Q, A776T, S881L, D999E) and possibly (A71T) damaging consequences[36]. Together with focal genomic losses of CTNND2 (FIG. 10b), the mutation pattern indicates that CTNND2 is a tumor suppressor gene in GBM.

Figure 3A:
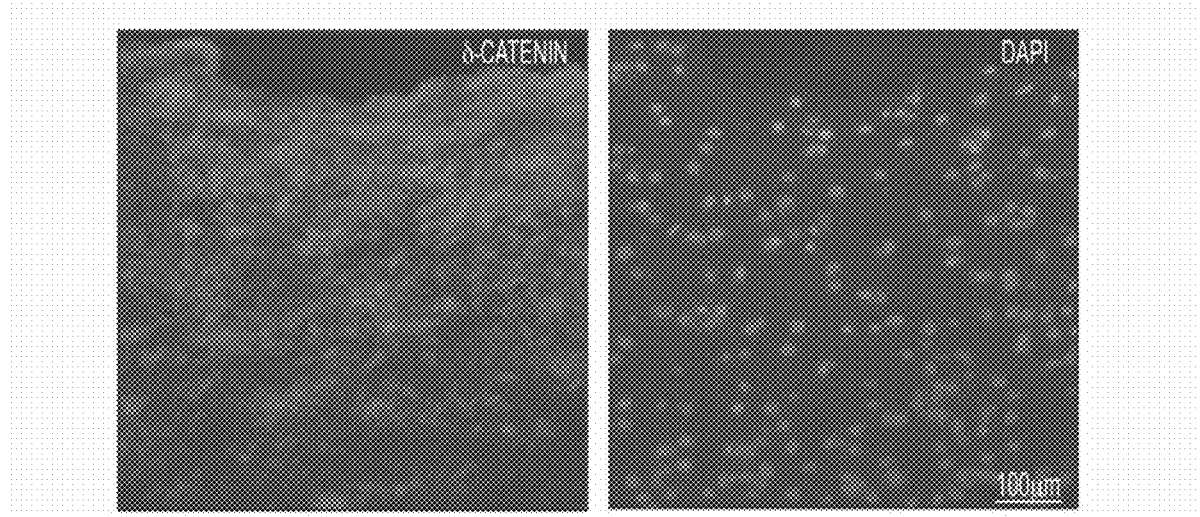
FIGS. 3A-B. Loss of C•••D• drives mesenchymal transformation of GBM. 3a, Immunofluorescence staining of human brain cortex using δ-catenin antibody (red, left panel); Nuclei are counterstained with Dapi (blue, right panel). 3b, Immunofluorescence staining of human primary GBM included in tissue microarrays (TMA) using δ-catenin antibody (red); Nuclei are counterstained with Dapi (blue). A representative δ-catenin-positive and negative tumor is shown in the left and right panel, respectively.
Figure 3B:
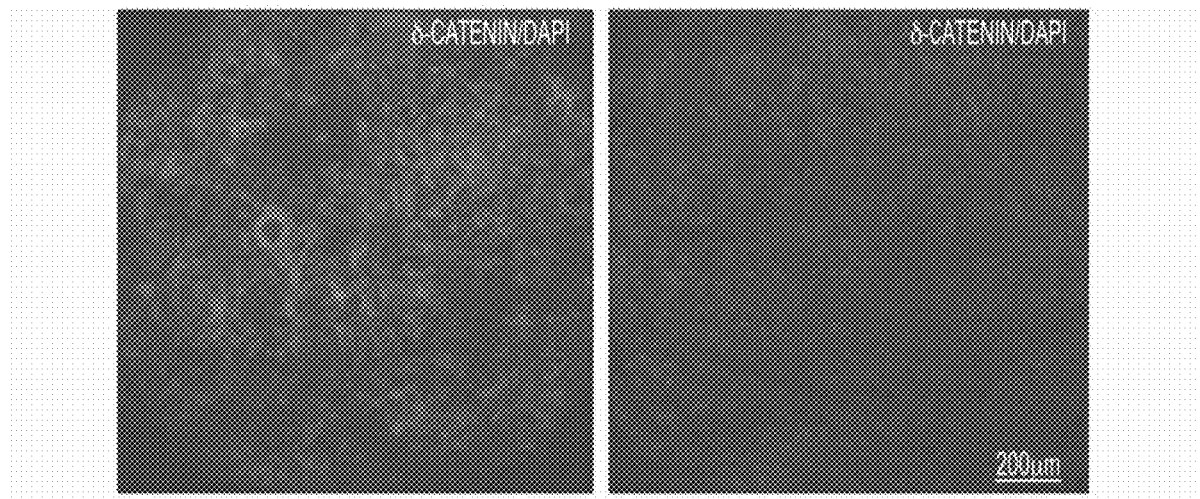
Figure 3C:
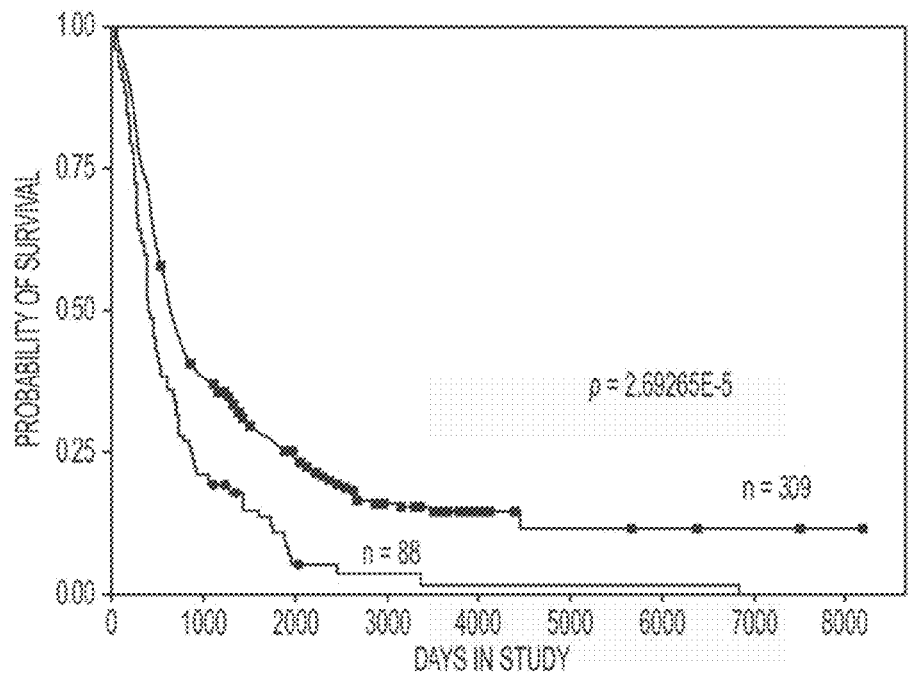
FIGS. 3C-D. Loss of C•••D• drives mesenchymal transformation of GBM. 3c, Kaplan-Meier analysis for glioma patients with low CTNND2 mRNA expression (≤2-fold, red line) compared with the rest of glioma (blue line). 3d, Kaplan-Meier analysis for glioma patients with low CTNND2 mRNA expression (2-fold) and decreased CTNND2 gene copy number (≤1) (red line) compared with the rest of glioma (blue line).
Figure 3D:
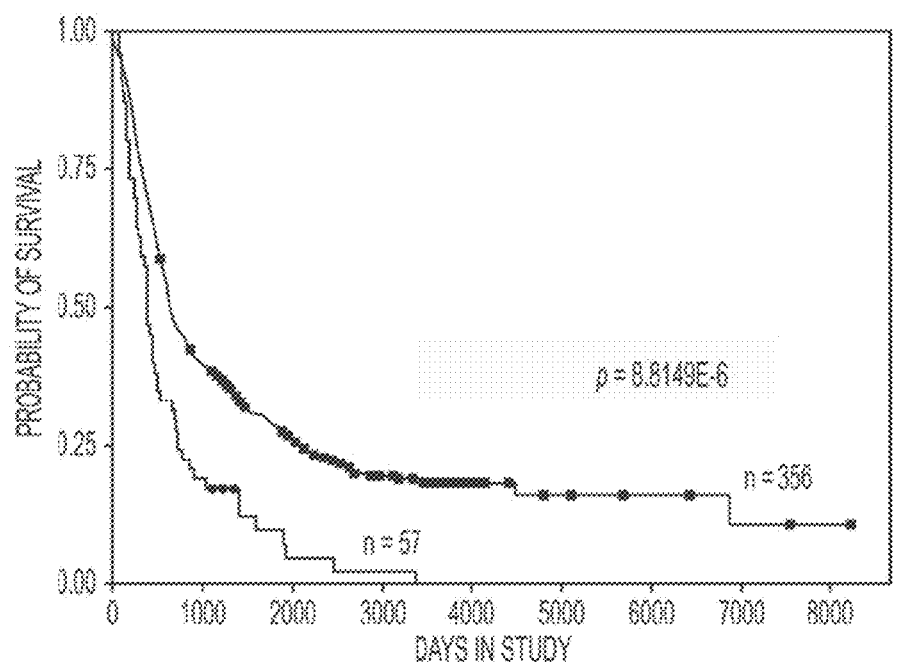
Figure 3E:
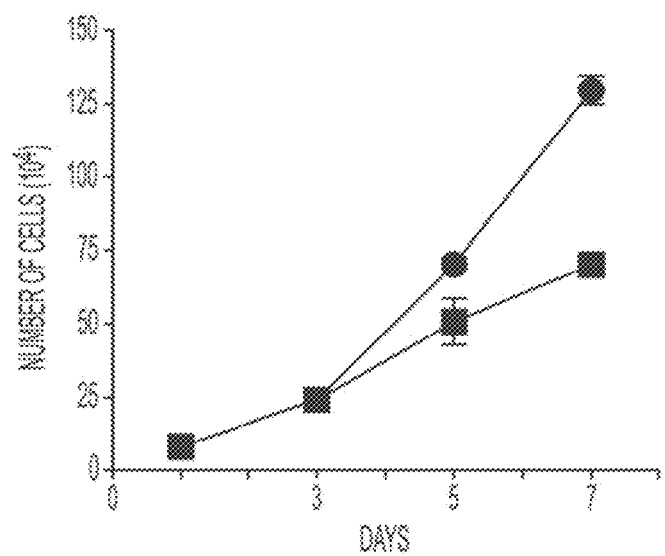
FIGS. 3E-F. Loss of C•••D• drives mesenchymal transformation of GBM. 3e, Growth rate of U87 glioma cells transduced with a lentivirus expressing δ-catenin (squares) or the empty vector (circles, average of triplicate cultures). 3f, Expression of mesenchymal genes in glioma cells expressing δ-catenin or the empty vector (averages of triplicate quantitative RT-PCR). All error bars are SD. *, p≤0.005; **, p≤0.001.
Figure 3F:
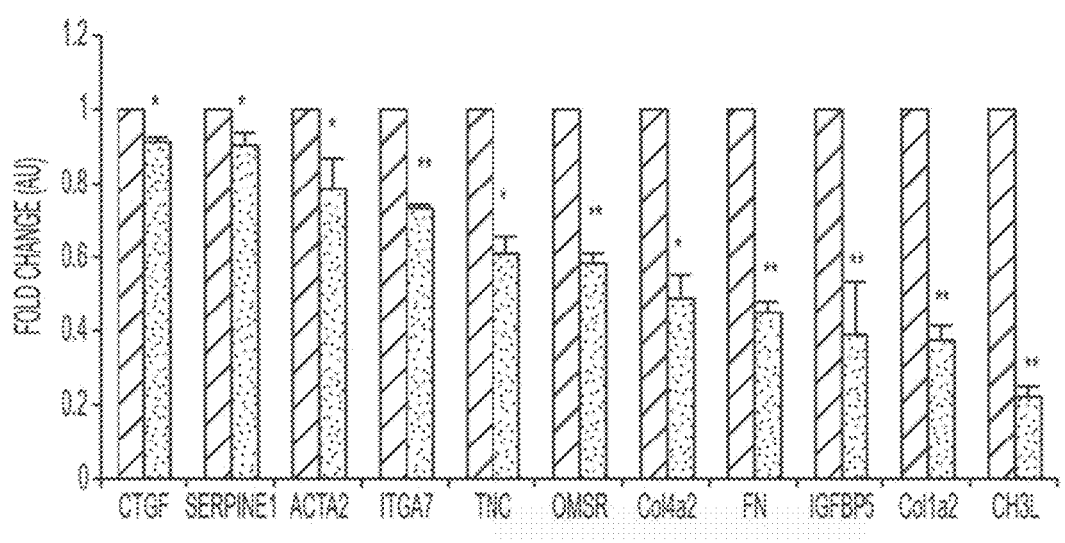
Figure 3G:
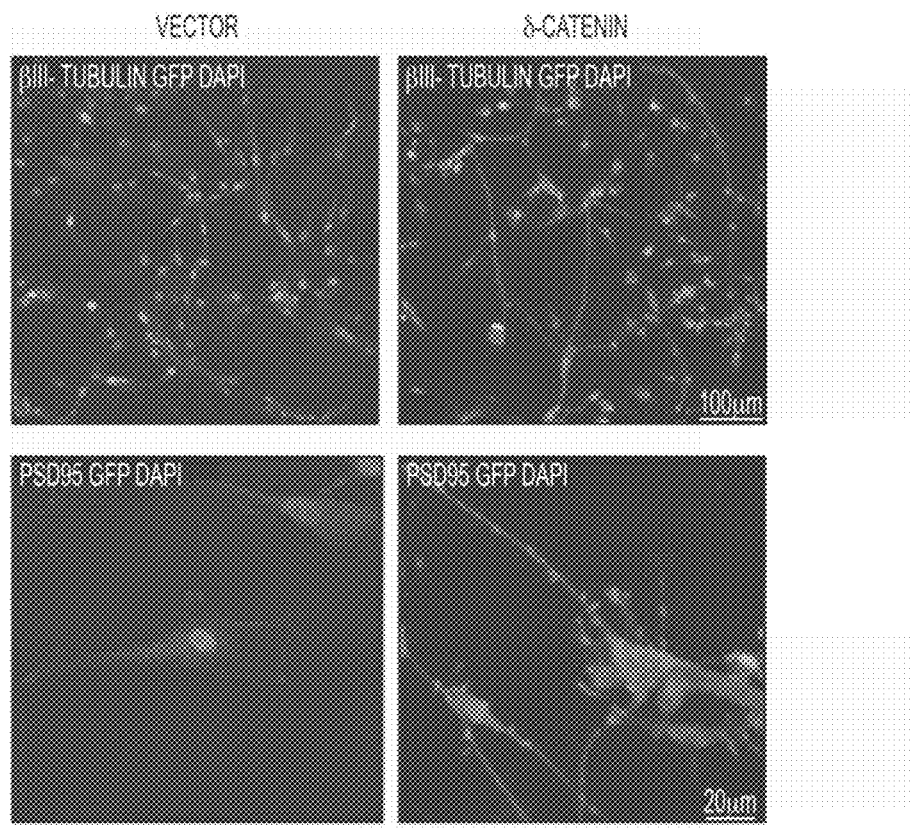
FIGS. 3G-H. Loss of C•••D• drives mesenchymal transformation of GBM. 3g, Immunofluorescence staining for βIII-tubulin (upper panels) and PSD95 (lower panels) in glioma cells expressing δ-catenin or the empty vector. 3h, Western blot using the indicated antibodies in glioma cells expressing δ-catenin or the empty vector. Vinculin is shown as control for loading.
Figure 3H:
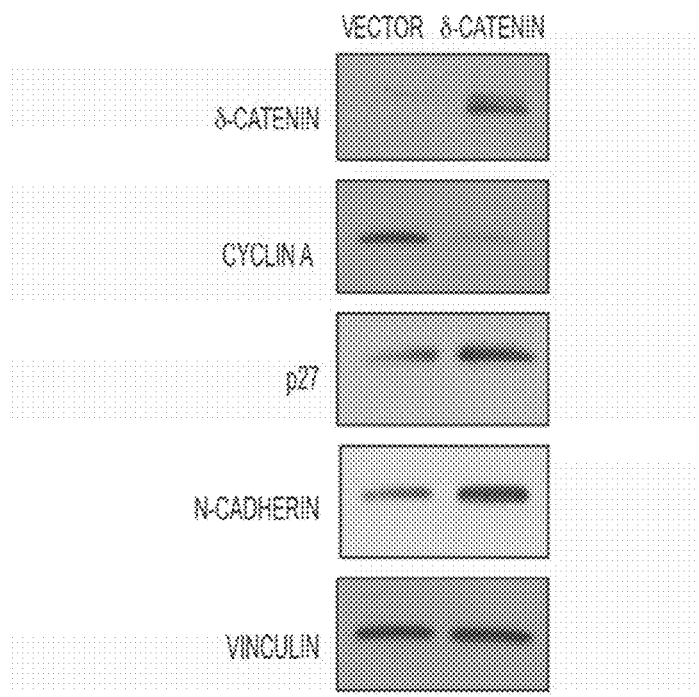
Figure 10C:
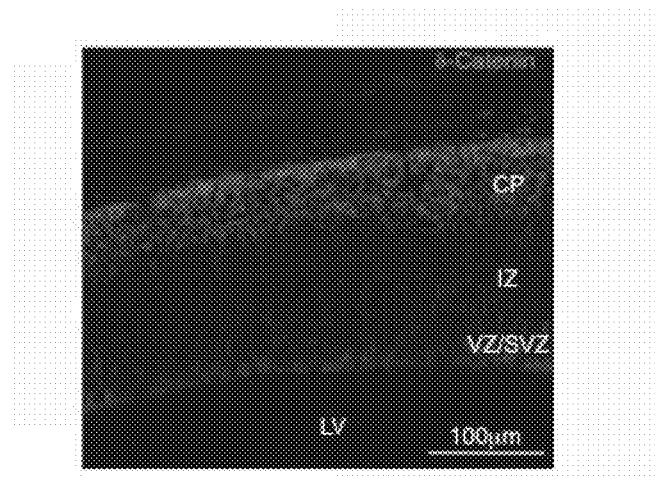
FIG. 10C. Pattern of somatic mutations, CNVs and expression of CTNND2 in GBM. Pattern of expression of δ-catenin in the developing mouse brain (embryonic day 14.5), as determined by immunostaining. The highest levels of δ-catenin are detected in the cortical plate (CP) that contains differentiating neurons. IZ, intermediate zone; VZ/SVZ ventricular zone/subventricular zone; LV, lateral ventricle.
Figure 10D:
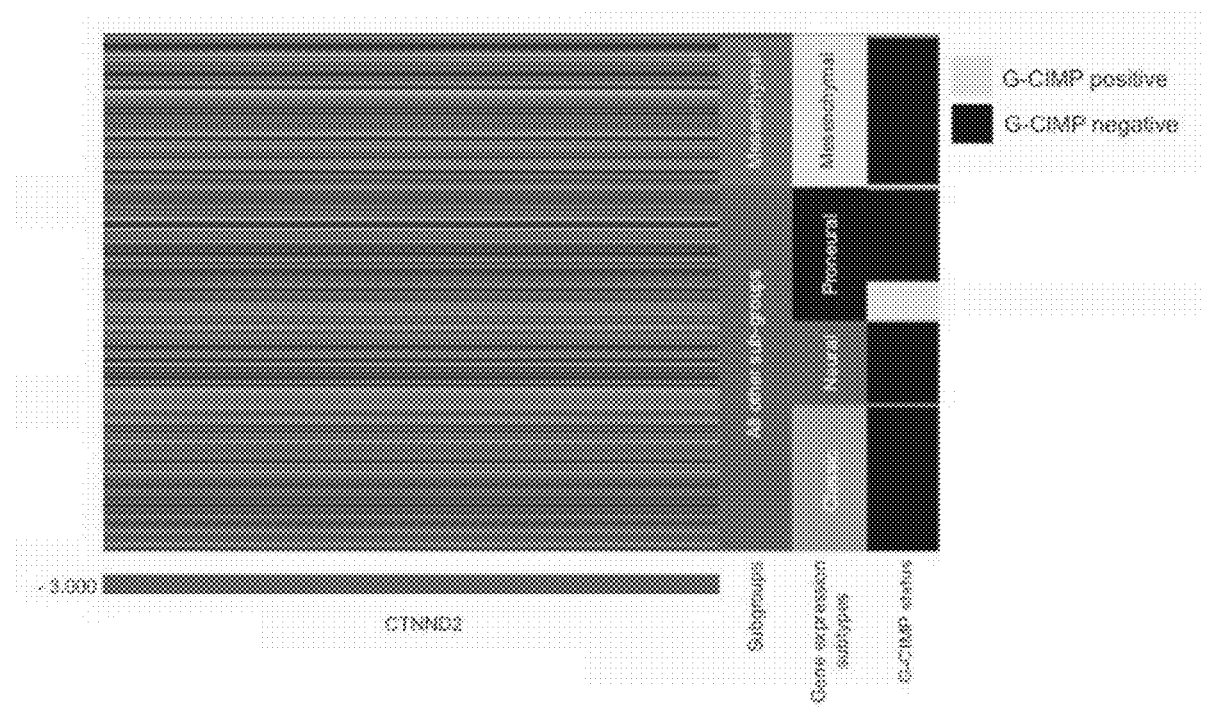
FIG. 10D. Pattern of somatic mutations, CNVs and expression of CTNND2 in GBM. CTNND2 mRNA expression analysis from Atlas-TCGA samples shows that CTNND2 is significantly down-regulated in the mesenchymal subgroup. In the green-red scale, black is the median, green is down-regulation and red is up-regulation.

It was asked whether the expression of CTNND2 is down-regulated during oncogenic transformation in the CNS. Immunostaining experiments showed that δ-catenin is strongly expressed in the normal human and mouse brain with the highest expression in neurons (FIG. 3a, FIG. 10c). Conversely, the immunostaining analysis of 69 GBM revealed negligible or absent expression of δ-catenin in 21 cases (FIG. 3b). Oncogenic transformation in the CNS frequently results in loss of the default proneural cell fate in favor of an aberrant mesenchymal phenotype, which is associated with a very aggressive clinical outcome[37]. The analysis of gene expression profiles of 498 GBM from the ATLAS-TCGA collection showed that low expression of CTNND2 is strongly enriched in tumors identified by a mesenchymal gene expression signature (T-test p-value=2.4 $10^{-12}$, FIG. 10d). Tumors with low CTNND2 expression were also characterized by poor clinical outcome and, among them tumors with copy number losses of the CTNND2 gene displayed the worst prognosis (FIG. 3c, d). Mesenchymal transformation of GBM, which is detected in the vast majority of established glioma cell lines, is associated with an apparently irreversible loss of the proneural cell fate and neuronal markers[37]. Expression of δ-catenin in the U87 human glioma cell line reduced cell proliferation (FIG. 3e), decreased the expression of mesenchymal markers (FIG. 30 and induced neuronal differentiation as shown by elongation of β3-tubulin-positive neurites and development of branched dendritic processes that stained positive for the post-synaptic marker PSD95 (FIG. 3g). Accordingly, δ-catenin decreased expression of cyclin A, a S-phase cyclin and up-regulated the Cdk inhibitor p27$^{Kip1}$ and the neuronal-specific gene N-cadherin (FIG. 3h). Thus, restoring the normal expression of δ-catenin reprograms mesenchymal glioma cells towards the proneural lineage.

Recurrent EGFR Fusions in GBM

To identify gene fusions in GBM, RNA-seq data was analyzed from a total of 185 GBM samples (161 primary GBM plus 24 short-term cultures of glioma stem-like cells (GSCs) freshly isolated from patients carrying primary GBM). The analysis of the RNA-seq dataset led to the discovery of 92 candidate rearrangements that give rise to in-frame fusion transcripts (FIG. 27). Beside the previously reported FGFR3-TACC3 fusions events, the most frequent recurrent in-frame fusions involved EGFR in 7.6% of samples (14/185, 3.8%-11.3% CI). Nine of the 14 EGFR fusions included the recurrent partners SEPT14 (6/185, 3.2%) and PSPH (3/185, 1.6%) as the 3' gene segment in the fusion. Two in-frame highly expressed fusions were also found involving the neurotrophic tyrosine kinase receptor 1 gene (NTRK1) as 3' gene with two different 5' partners (NFASC-NTRK1 and BCAN-NTRK1). Fusions with a similar structure involving NTRK1 are commonly found in papillary thyroid carcinomas[38]. Using EXomeFuse, an algorithm for the reconstruction of genomic fusions from whole-exome data, EGFR-SEPT14 and NRTK1 fusions are the result of recurrent chromosomal translocations and reconstructed the corresponding genomic breakpoints (FIG. 27).

Figure 4A:
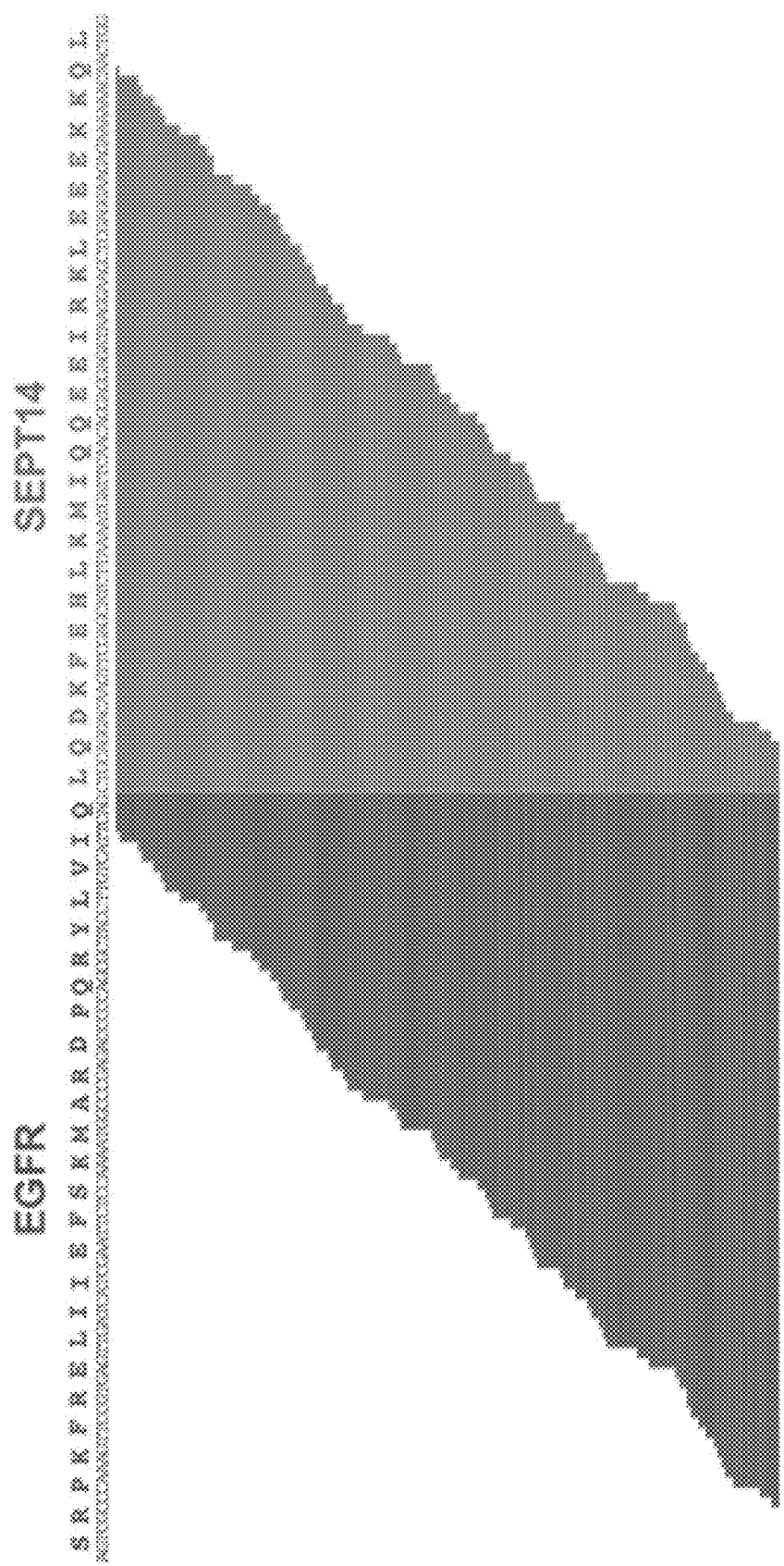
FIG. 4A. EGFR-SEPT14 gene fusion identified by whole transcriptome sequencing. Split reads are shown aligning on the breakpoint. The predicted reading frame at the breakpoint is shown at the top with EGFR sequences in blue and SEPT14 in red. The amino acid sequence (TOP) is SEQ ID NO: 1; the nucleotide sequence (bottom) is SEQ ID NO: 2.
Figure 11A:
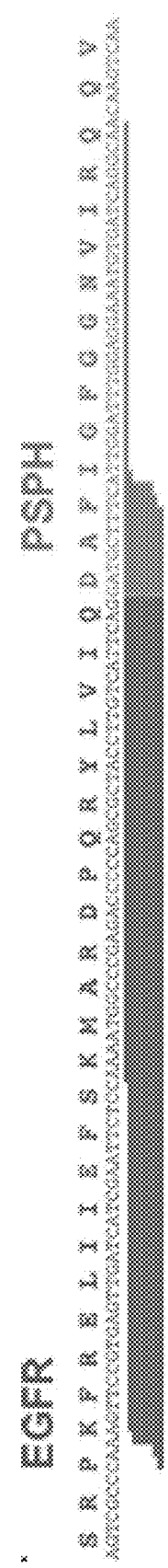
FIG. 11A. EGFR-PSPH gene fusion identified by whole transcriptome sequencing. Split reads are shown aligning on the breakpoint. The predicted reading frame at the breakpoint is shown at the top with EGFR sequences in blue (grey in black and white image; encompassing "SRR . . . VIQ" amino acids and "AGT . . . CAG" nucleotides) and PSPH in red (light grey in black and white image; encompassing "DAF . . . QQV" amino acids and "GAT . . . CAA" nucleotides). The amino acid sequence (TOP) is SEQ ID NO: 7; the nucleotide sequence (bottom) is SEQ ID NO: 8.
Figure 11B:
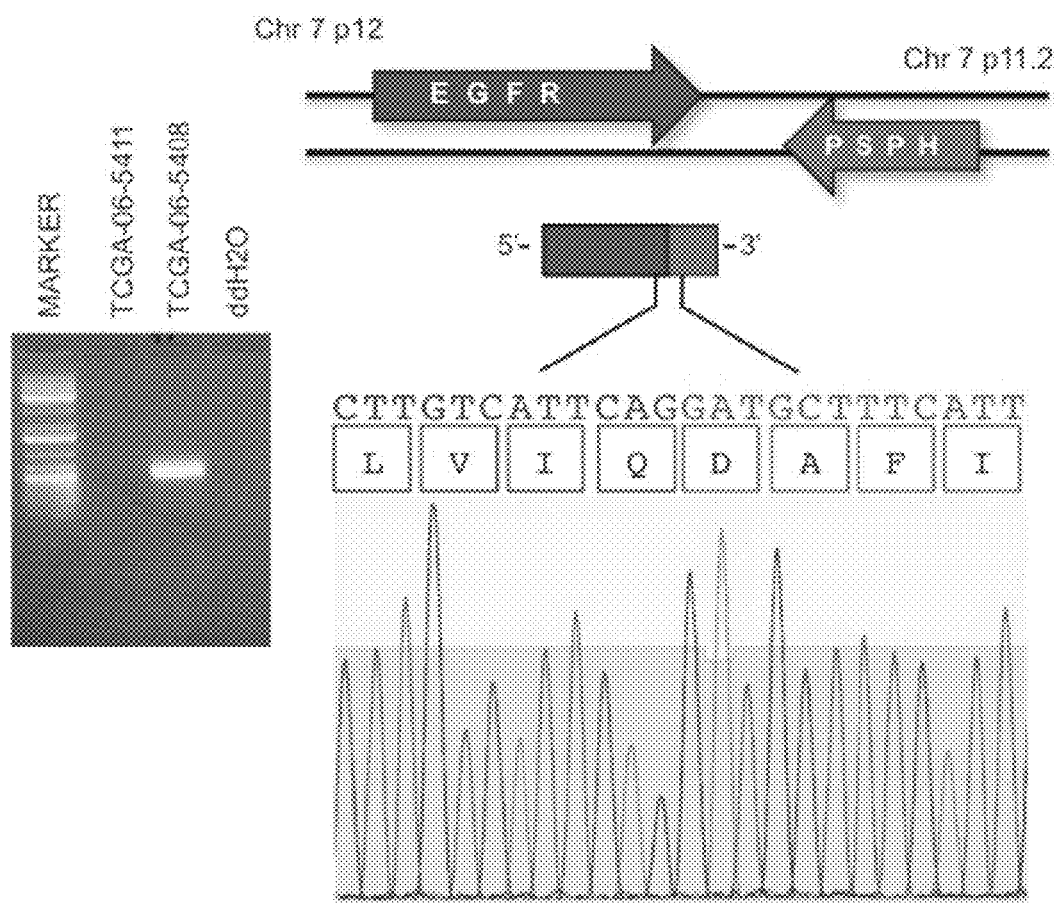
FIG. 11B. EGFR-PSPH gene fusion identified by whole transcriptome sequencing. (left panel), EGFR-PSHP specific PCR from cDNA derived from GBMs. Marker, 1 kb ladder. (right panel), Sanger sequencing chromatogram showing the reading frame (SEQ ID NO: 10) at the breakpoint and putative translation of the fusion protein (SEQ ID NO: 9) in the positive sample.
Figure 11C:
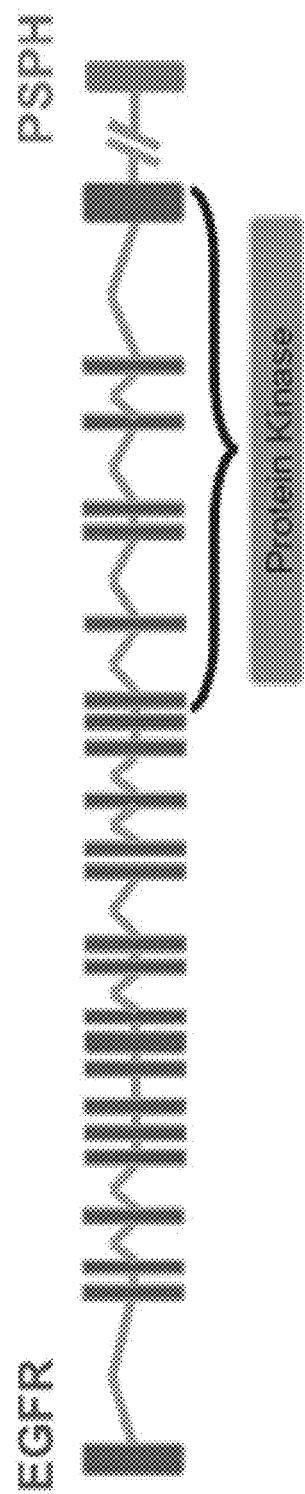
FIG. 11C. EGFR-PSPH gene fusion identified by whole transcriptome sequencing. EGFR-PSPH fusion protein sequence (SEQ ID NO: 11) and schematics. Regions corresponding to EGFR and PSPH are shown in blue (grey in black and white image; left hand side of schematic; sequence comprising "MRP . . . VIQ" amino acids of SEQ ID NO: 11) and red (light grey in black and white image; right hand side of schematic, encompassing amino acids "DAF . . . LEE" of SEQ ID NO: 11), respectively. The fusion includes the tyrosine kinase domain of EGFR and the last 35 amino acids of PSPH.
Figure 12A:
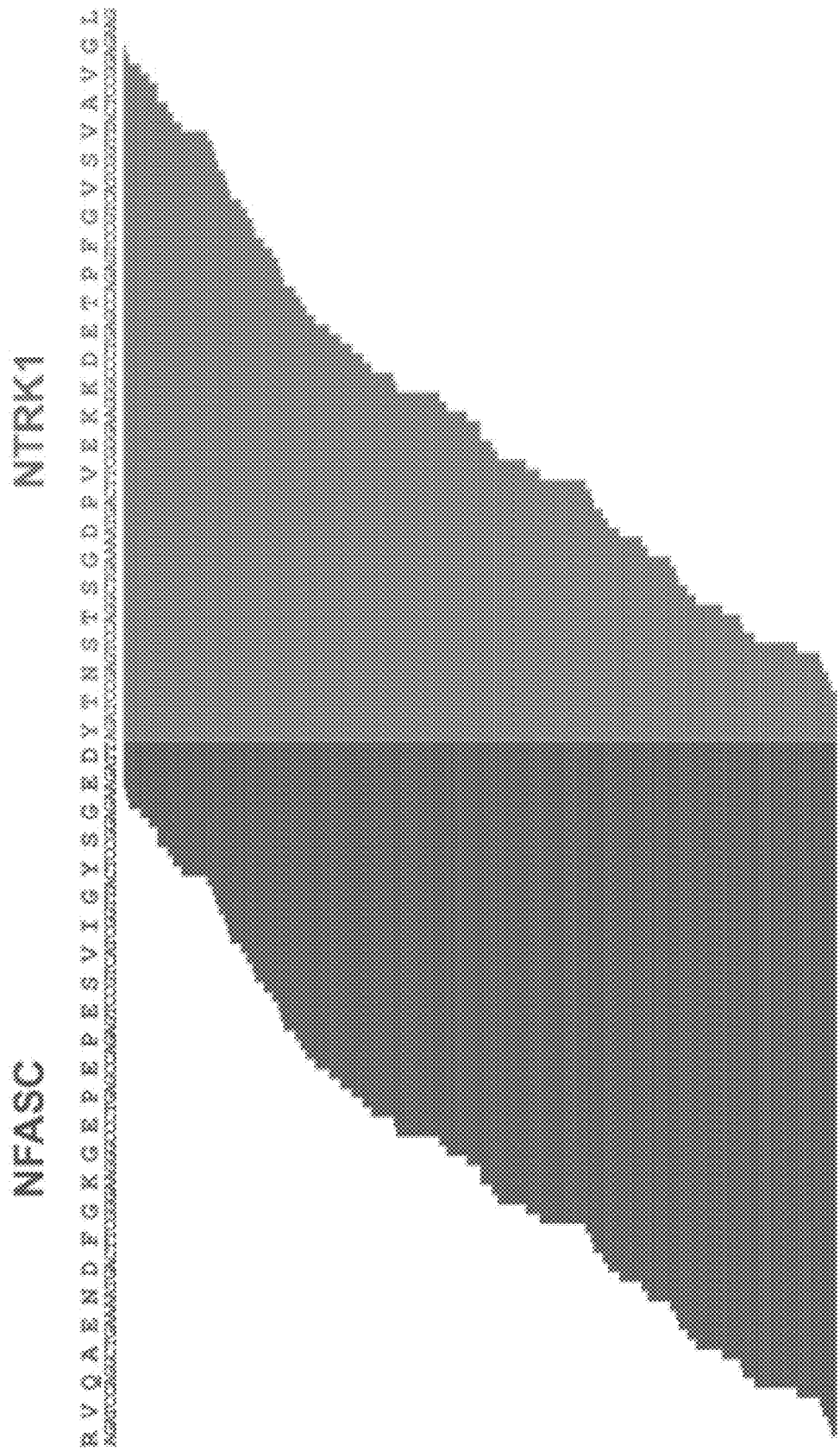
FIG. 12A. NFASC-NTRK1 gene fusion identified by whole transcriptome sequencing. Split reads are shown aligning on the breakpoint. The predicted reading frame at the breakpoint is shown at the top with NFASC sequences in blue (grey in black and white image; encompassing "RVQ . . . GED" amino acids and "AGA . . . ATT" nucleotides) and NTRK1 in red (light grey in black and white image; encompassing "YTN . . . VGL" amino acids and "AGA . . . AAG" nucleotides). Figure discloses SEQ ID NOS 8489-8490, respectively, in order of appearance.
Figure 12B:
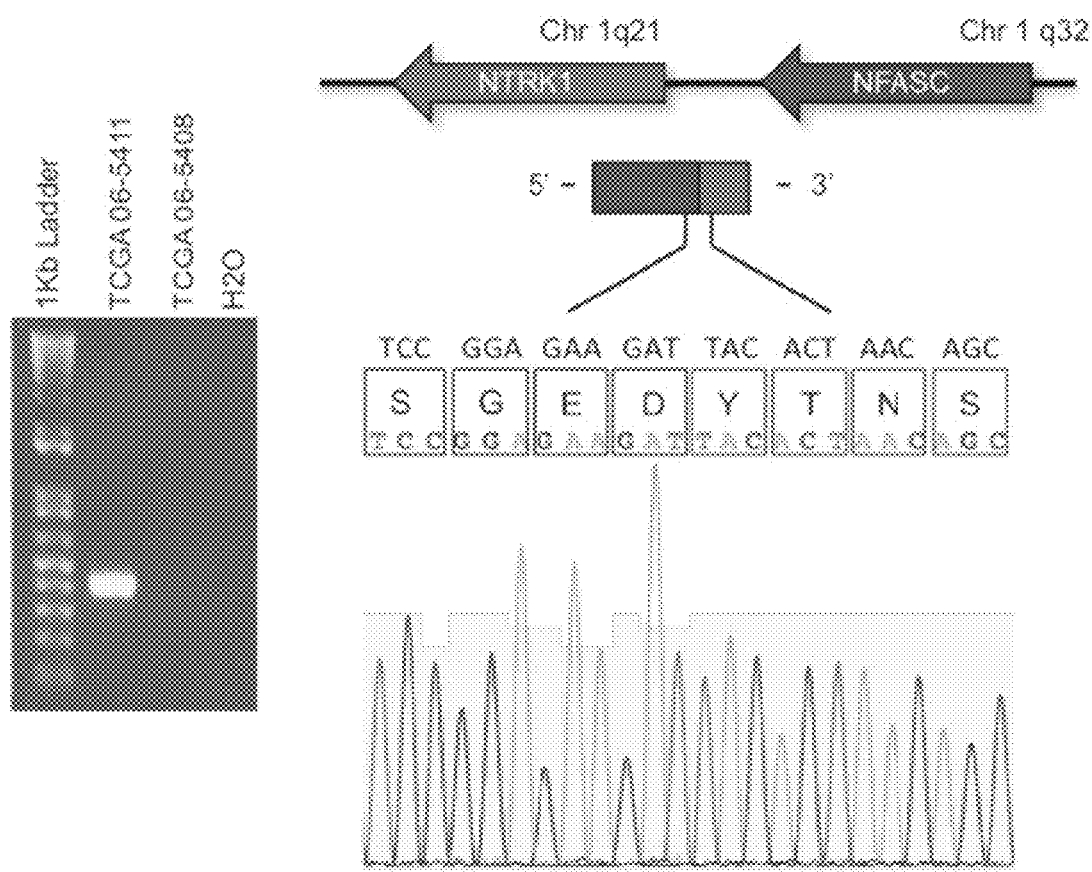
FIG. 12B. NFASC-NTRK1 gene fusion identified by whole transcriptome sequencing. (left panel), NFASC-NTRK1 specific PCR from cDNA derived from GBMs. Marker, 1 kb ladder. (right panel), Sanger sequencing chromatogram showing the reading frame (SEQ ID NO: 8491) at the breakpoint and putative translation of the fusion protein (SEQ ID NO: 8492) in the positive sample.
Figure 12C:
FIG. 12C. NFASC-NTRK1 gene fusion identified by whole transcriptome sequencing. NFASC-NTRK1 fusion protein sequence (SEQ ID NO: 8493) and schematics. Regions corresponding to NFASC and NTRK1 are shown in blue (grey in black and white image; sequence comprising "MAR . . . GED" amino acids) and red (light grey in black and white image; sequence comprising "YTN . . . VLG" amino acids), respectively. The fusion includes two of the five fibronectin-type III domain of neurofascin and the protein kinase domain of NTRK1.
Figure 12D:
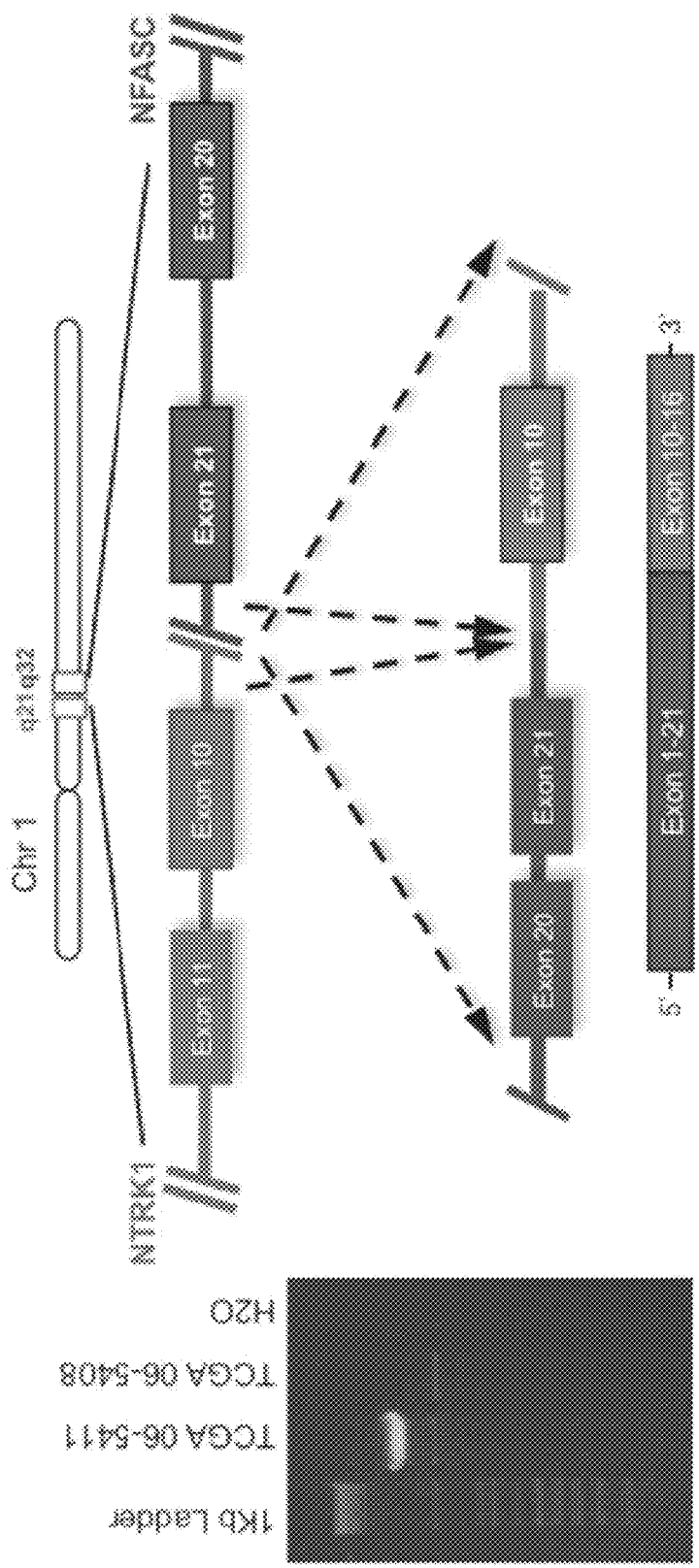
FIG. 12D. NFASC-NTRK1 gene fusion identified by whole transcriptome sequencing. Genomic fusion of NFASC intron 9 with intron 21 of NTRK1. In the fuse mRNA exon 21 of NFASC is spliced 5' to exon 10 of NTRK1. Solid arrows indicate the position of the fusion genome primers that generate a fusion specific PCR product in the GBM sample TCGA-06-5411.
Figure 13:
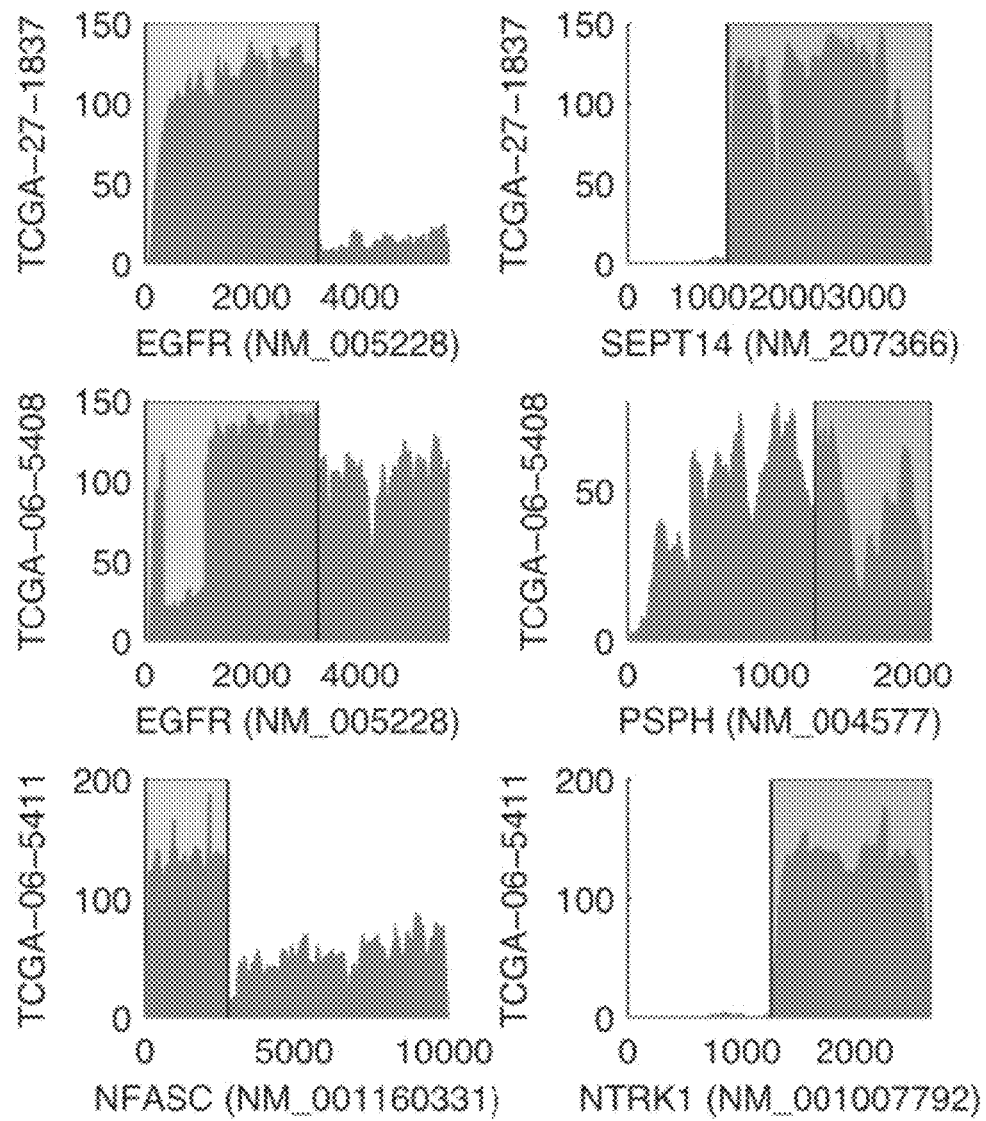
FIG. 13 shows the expression measured by read depth from RNA-seq data. Note the very high level of expression in the regions of the genes implicated in the fusion events.
Figure 14B:
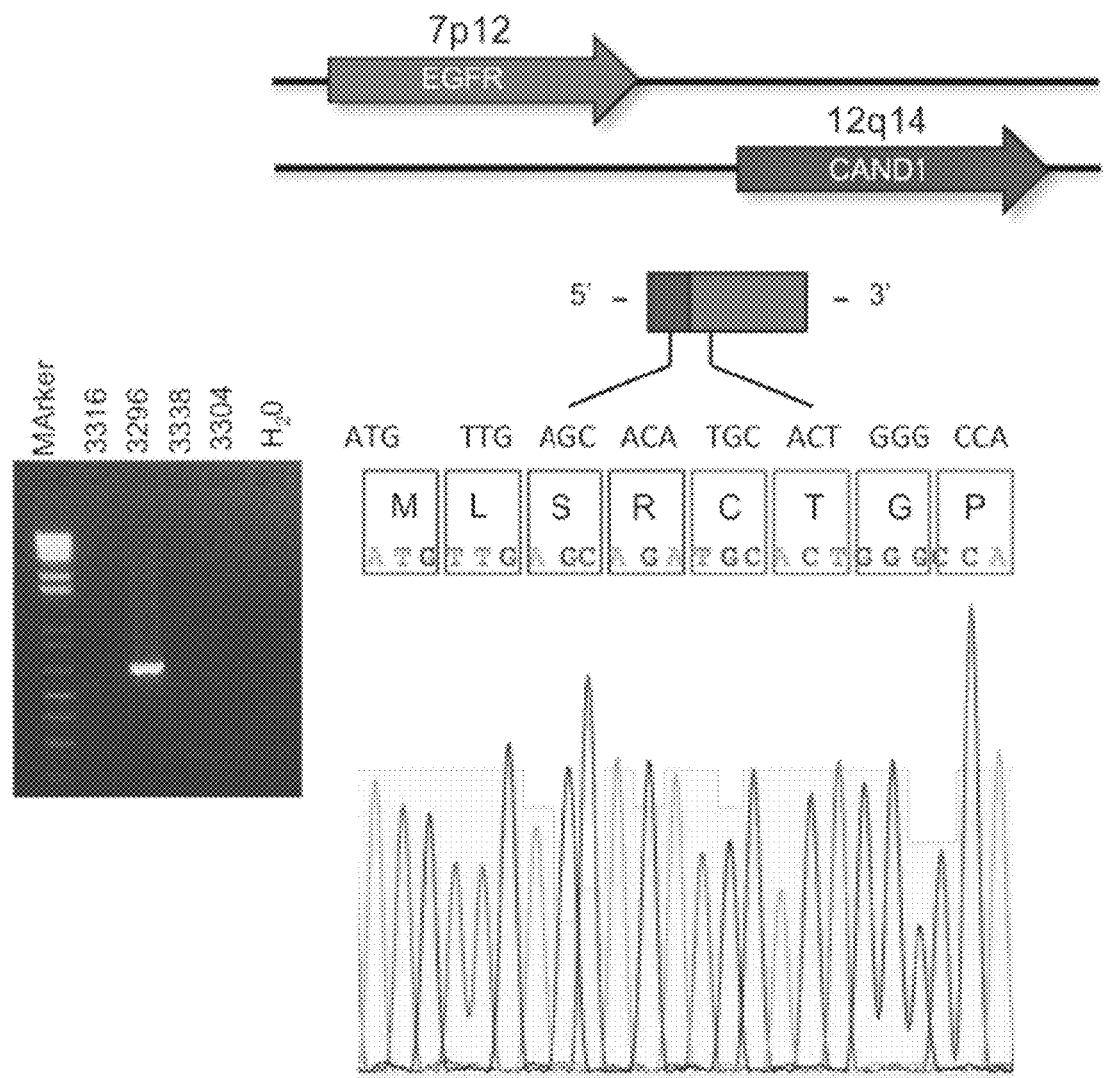
FIG. 14B. CAND1-EGFR gene fusion identified by whole transcriptome sequencing. (left panel), CAND1-EGFR specific PCR from cDNA derived from GBMs. Marker, 1 kb ladder. (right panel), Sanger sequencing chromatogram showing the reading frame at the breakpoint (SEQ ID NO: 15) and putative translation of the fusion protein (SEQ ID NO: 16) in the positive sample (boxed sequences). Figure also discloses SEQ ID NO: 8494.

By sequencing the PCR products spanning the fusion breakpoint, each of the three types of recurrent in-frame fusion predictions (EGFR-SEPT14, EGFR-PSPH and NRTK1 fusions, FIG. 4, FIG. 11, and FIG. 12) were validated. In FIG. 4a, b the prediction and cDNA sequence validation are shown, respectively, for one of the tumors harboring an EGFR-SEPT14 fusion (TCGA-27-1837). The amplified cDNA contained an open reading frame for a protein of 1,041 amino acids resulting from the fusion of an EGFR amino-terminal portion of residues 1-982 with a SEPT14 carboxy-terminal portion of residues 373-432 (FIG. 4c). Thus, the structure of the EGFR-Septin14 fusion proteins involves EGFR at the N-terminus, providing a receptor tyrosine kinase domain fused to a coiled-coil domain from Septin14. Exon-specific gene expression analysis from the RNA-seq coverage in TCGA-27-1837 demonstrated that the EGFR and SEPT14 exons implicated in the fusion are highly overexpressed compared with the mRNA sequences not included in the fusion event (FIG. 13). Using PCR, the genomic breakpoint coordinates were mapped to chromosome 7 (#55,268,937 for EGFR and #55,870,909 for SEPT14, genome build GRCh37/hg19) falling within EGFR exon 25 and SEPT14 intron 9, which gives rise to a transcript in which the 5' EGFR exon 24 is spliced to the 3' SEPT14 exon 10 (FIG. 4d). Interestingly, the fused EGFR-PSPH cDNA and predicted fusion protein in the GBM sample TCGA-06-5408 involves the same EGFR N-terminal region implicated in the EGFR-SEPT14 with PSPH providing a carboxy-terminal portion of 35 amino acids (FIG. 11). An example of a fusion in which the EGFR-TK region is the 3' partner is the CAND1-EGFR fusion in GSC-3316 (FIG. 14). Thus, either in the more frequent fusions in which EGFR is the 5' partner or in those with EGFR as the 3' gene, the region of the EGFR mRNA coding for the TK domain is invariably retained in each of the fusion transcripts (FIG. 27). RT-PCR and genomic PCR followed by Sanger sequencing from GBM TCGA-06-5411 were also used to successfully validate successfully the NFASC-NTRK1 fusions in which the predicted fusion protein includes the TK domain of the high-affinity NGF receptor (TrkA) fused downstream to the immunoglobulin-like region of the cell adhesion and ankyrin-binding region of neurofascin (FIG. 12).

To confirm that GBM harbor recurrent EGFR fusions and determine the frequency in an independent dataset, cDNA was screened from a panel of 248 GBMs and discovered 10 additional cases harboring EGFR-SEPT14 fusions (4%). Conversely, NFASC-NTRK1 fusions were not detected in this dataset. The frequency of EGFR-PSPH fusions was 2.2% (3/135).

Figure 5A:
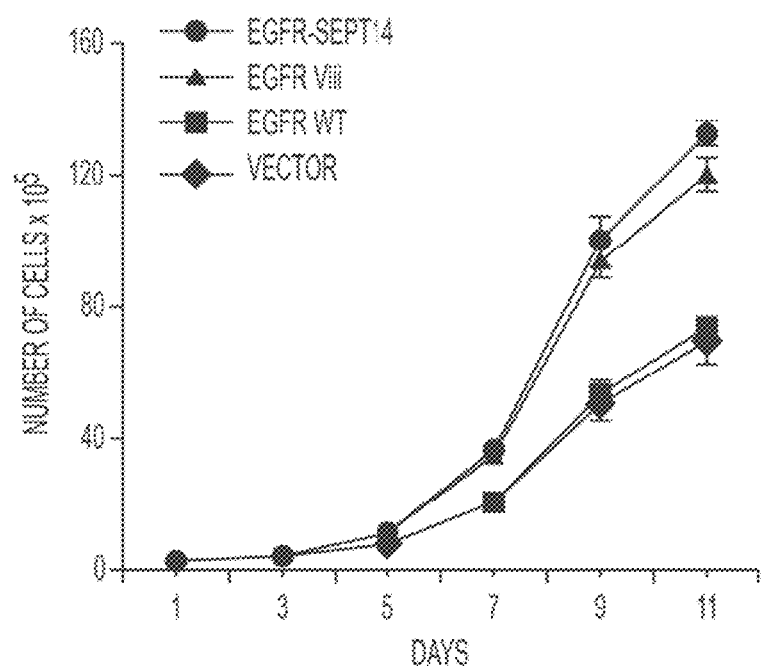
FIG. 5A. Expression of EGFR-SEPT14 fusion promotes an aggressive phenotype and inhibition of EGFR kinase delays GBM growth in vivo. Growth rate of SNB19 glioma cells transduced with a lentivirus expressing EGFR-SEPT14, EGFR Viii, EGFR WT or the empty vector (average of triplicate cultures).
Figure 5B:
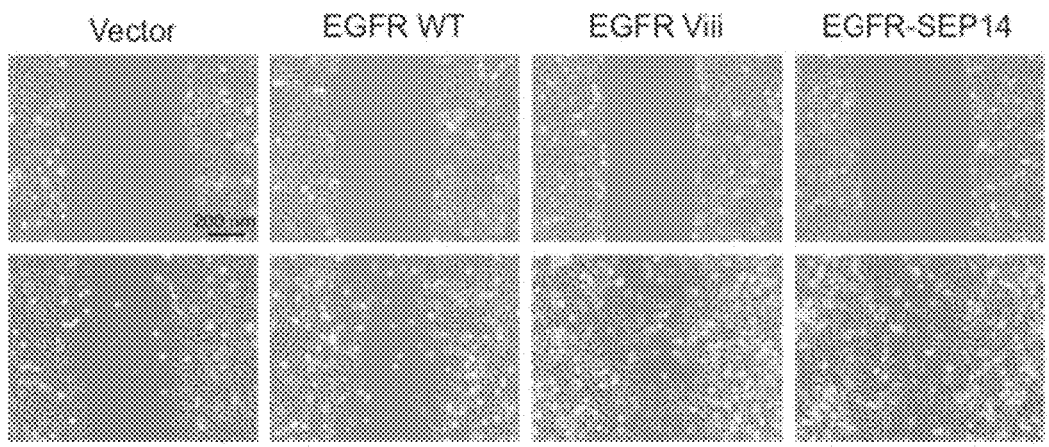
FIG. 5B. Expression of EGFR-SEPT14 fusion promotes an aggressive phenotype and inhibition of EGFR kinase delays GBM growth in vivo. Migration assay in SNB19 glioma cells transduced with a lentivirus expressing EGFR-SEPT14, EGFR Viii, EGFR WT or the empty vector.

The discovery of recurrent EGFR fusions in GBM is of particular interest. EGFR is activated in a significant fraction of primary GBM (~25%) by an in-frame deletion of exons 2-7 (EGFRvIII)[39]. To establish the functional relevance of EGFR fusions, it was determined whether the most frequent EGFR fusion in GBM (EGFR-SEPT14) provides an alternative mechanism of EGFR activation and confers sensitivity to EGFR inhibition. The EGFR-SEPT14 cDNA was cloned and prepared lentiviruses expressing EGFR-SEPT14, EGFRvIII or EGFR wild type. Transduction of the SNB19 glioma cell line (which lacks genomic alteration of EGFR) with the recombinant lentiviruses showed that cells expressing EGFR-SEPT14 or EGFRvIII proliferated at a rate that was 2-fold higher than control cells or cells expressing wild type EGFR (FIG. 5a). Furthermore, EGFR-SEPT14 and EGFRvIII markedly enhanced the ability of SNB19 cells to migrate in a wound assay (FIG. 5b, c). Finally it was investigated whether EGFR-SEPT14 fusions confer sensitivity to EGFR-TK activity in vivo. The analysis of a collection of 30 GBM xenografts directly established in the mouse from human GBM identified one xenograft model (D08-0537 MG) harboring the EGFR-SEPT14 fusion. The D08-0537 MG had been established from a heavily pretreated GBM. Treatment of D08-0537 MG tumors with two EGFR inhibitors showed that each of the two drugs significantly delayed the rate of tumor growth (FIG. 5d). Interestingly, lapatinib, an irreversible EGFR inhibitor recently proposed to target EGFR alterations in GBM[40], displayed the strongest anti-tumor effects (FIG. 5d, e). Conversely, EGFR inhibitors were ineffective against the GBM xenograft D08-0714 MG, which lacks genomic alterations of the EGFR gene (FIG. 5d, e). Taken together, these data determine that the EGFR-SEPT14 fusion confers a proliferative and migratory phenotype to glioma cells and imparts sensitivity to EGFR inhibition to human glioma harboring the fusion gene.

Discussion

A computational pipeline is described for the nomination of somatic cancer genes. This approach computes frequency, magnitude and focality of CNVs at any loci in the human genome with the somatic mutation rate for the genes residing at that genomic location. Thus, two of the genetic hallmarks of driver cancer genes (focality of copy number aberrations and point mutations) are integrated into a single score. The approach identifies marks of positive somatic selection in large unbiased cancer genome studies by efficiently removing the large burden of passenger mutations that characterize most human tumors and will be applicable to the dissection of the genomic landscape of other cancer types.

Besides recognizing nearly all the known genes reported to have functional relevance in GBM, our study discovered and validated somatic mutations in 18 new genes, which also harbor focal and recurrent CNVs in a significant fraction of GBM. For some of these genes, their importance extends beyond GBM, as underscored by cross-tumor relevance (e.g. BCOR), and protein family recurrence (e.g. LRP family members). For example, mutations of LZTR-1 have been reported in other tumors. In particular, mutations of the highly conserved residues in the Keltch domain (W105, G248, T288) and in the second BTB-BACK domain (R810) reported here are recurrent events in other tumor types[41]. Thus, understanding the nature of the substrates of LZTR-1-Cul3 ubiquitin ligase activity will provide important insights into the pathogenesis of multiple cancer types.

The identification of genetic and epigenetic loss-of-function alterations of the CTNND2 gene clustered in mesenchymal GBM provides a clue to the genetic events driving this aggressive GBM subtype. The important functions of S-catenin for such crucial neuronal morphogenesis activities as the coordinated control of axonal and dendritic arborization indicates that full-blown mesenchymal transformation in the brain requires loss of the master regulators constraining cell determination in the CNS along the default neuronal lineage. The ability of δ-catenin to reprogram glioma cells that express mesenchymal genes towards a neuronal fate unravels an unexpected plasticity of mesenchymal GBM that might be exploited therapeutically.

In this study, the landscape of gene fusions is reported from a large dataset of GBM analyzed by RNA-Sequencing. In-frame gene fusions retaining the RTK-coding domain of EGFR emerged as the most frequent gene fusion events in GBM. In this tumor, EGFR is frequently targeted by focal amplications and our finding underscores the strong recombinogenic probability of focally amplified genes, as recently reported for the myc locus in medulloblastoma[42]. Resembling intragenic rearrangements that generate the EGFRvIII allele, EGFR-SEPT14 fusions enhance the proliferative and migratory capacity of glioma cells. They also confer sensitivity to EGFR inhibition to human GBM grown as mouse xenografts. These findings highlight the relevance of gene fusions implicating RTK-coding genes in the pathogenesis of GBM[9]. They also provide a strong rationale for the inclusion of GBM patients harboring EGFR fusions in clinical trials based on EGFR inhibitors.

Methods 139 paired tumor-normal samples from TCGA were analyzed with the SAVI pipeline. The SAVI algorithm estimates frequencies of variant alleles in sample as well as the difference in allele frequency between paired samples. The algorithm establishes posterior high credibility intervals for those frequencies and differences of frequencies, which can be used for genotyping the samples on the one hand, and detecting somatic mutations in the case of tumor/normal pairs of samples on the other. The algorithm allows for random sequencing errors and uses the Phred scores of the sequenced alleles as an estimate of their reliability. To integrate point mutation and 469 GBM CNV data (Affymetrix SNP6.0), MutComFocal (see below) was used. The MutComFocal algorithm assigns a driver score to each gene through three different strategies that give priority to lesions, samples, and genes in which there is less uncertainty regarding potential tumorigenic drivers. First, the focality component of the score is inversely proportional to the size of the genomic lesion to which a gene belongs and thus prioritizes more focal genomic lesions. Second, the recurrence component of the MutComFocal score is inversely proportional to the total number of genes altered in a sample, which prioritizes samples with a smaller number of altered genes. Finally, the mutation component of the score is inversely proportional to the total number of genes mutated in a sample, which achieves the two-fold goal of prioritizing mutated genes on one hand, and samples with a smaller number of mutations on the other.

161 RNA-Seq GBM tumor samples were also analyzed from TCGA plus 24 generated from our own dataset of GSCs. Nine of these samples previously reported in other studies were kept in the list to evaluate recurrence[9]. The samples were analyzed by means of the ChimeraScan algorithm in order to detect a list of gene fusion candidates[44]. Using the Pegasus annotation pipeline (http://sourceforge.net/projects/pegasus-fus/), the fusion transcript was reconstructed, the reading frame was annotated and protein domains were detected that are either conserved or lost in the new chimeric event. The genomic breakpoint of recurrent gene fusion RNA transcripts was also probed for using whole-exome sequencing data (EXome-Fuse algorithm)[9]. The Kaplan-Meier survival analysis for CTNND2 CNV and CTNND2 expression were obtained using the REMBRANDT glioma dataset.

SAVI (Statistical Algorithm for Variant Frequency Identification):

The frequency of alleles in a sample was estimated by the SAVI pipeline, which constructs an empirical Bayesian prior for those frequencies, using data from the whole sample, and obtains a posterior distribution and high credibility intervals for each allele[S1]. The prior and posterior are distributed over a discrete set of frequencies with a precision of 1% and are connected by a modified binomial likelihood, which allows for some error rate. More precisely, a prior distribution p(f) of the frequency f and a prior for the error e uniform on the interval [0, E] was assumed for a fixed $0 \le E \le 1$. The sequencing data at a particular allele is a random experiment producing a string of m (the total depth at the allele) bits with n "1"s (the variant depth at the allele). Assuming a binomial likelihood of the data and allowing for bits being misread due to random errors, the posterior probability P(f) of the frequency f is $$P(f) = \frac{p(f)}{C} \cdot \frac{1}{b-a} \int_{f}^{f+E-2Ef} x^n (1-x)^{m-n} dx$$

where C is a normalization constant. For a particular allele, the value of E is determined by the quality of the nucleotides sequenced at that position as specified by their Phred scores. The SAVI pipeline takes as input the reads produced by the sequencing technology, filters out low quality reads and maps the rest onto a human reference genome. After mapping, a Bayesian prior for the distribution of allele frequencies for each sample is constructed by an iterative posterior update procedure, starting with a uniform prior. To genotype the sample, the posterior high credibility intervals were used for the frequency of the alleles at each genomic location. Alternatively, combining the Bayesian priors from different samples, posterior high credibility intervals were obtained for the difference between the samples of the frequencies of each allele. Finally, the statistically significant differences between the tumor and normal samples are reported as somatic variants. To estimate the positive prediction value of SAVI in the TCGA GBM samples, 41 mutations were selected for independent validation by Sanger sequencing. 39 of the 41 mutations were confirmed using Sanger sequencing, resulting in 0.95 (95% CI 0.83-0.99) validation rate.

Candidate genes were ranked by the number of somatic non-synonymous mutations. A robust fit of the ratio of non-synonymous to synonymous ratio was generated with a bisquare weighting function. Excess of non-synonymous alterations was estimated using a Poisson distribution with mean equal to the product of the ratio from the robust fit and the number of synonymous mutations. Genes in highly polymorphic genomic regions were filtered out based on an independent cohort of normal samples. The list of these regions includes families of genes known to generate false positives in somatic predictions (e.g. HLA, KRT and OR).

MutComFocal.

Key cancer genes are often found amplified or deleted in chromosomal regions containing many other genes. Point mutations and gene fusions, on the other hand, provide more specific information about which genes may be implicated in the oncogenic process. MutComFocal, a Bayesian approach aiming to identify driver genes by integrating CNV and point mutation data was developed.

For a particular sample, let $(c_1,N_1), \ldots (c_k,N_k)$ describe the amplification lesions in that sample so that $N_i$ is the number of genes in the i-th lesion and $c_i$ is its copy number change from normal. For a gene belonging to the i-th lesion the amplification recurrence sample score is defined as $c_i/(\Sigma_j c_j \cdot N_j)$ and its amplification focality sample score is defined as $(c_i/\Sigma_j c_j) \cdot (1/N_i)$. To obtain the amplification recurrence and focality scores for a particular gene, the corresponding sample scores were summed over all samples and normalize the result so that each score sums to 1. The deletion and recurrence scores are defined in a similar manner. The mutation score is analogous to a recurrence score in which it was assumed that mutated genes belong to lesions with only one gene.

The amplification/mutation score is defined as the product of the two amplification scores and the mutation score while deletion/mutation score is defined as the product of the two deletion scores and the mutation score. The amplification/mutation and deletion/mutation scores are normalized to 1 and for each score, genes are divided into tiers iteratively, so that the top $2^H$ remaining genes are included in the next tier, where H is the entropy of the scores of the remaining genes normalized to 1. Based on their tier across the different types of scores, genes are assigned to being either deleted/mutated or amplified/mutated and genes in the top tiers are grouped into contiguous regions. The top genes in each region are considered manually and selected for further functional validation.

The recurrence and focality scores can be interpreted as the posterior probabilities that a gene is driving the selection of the disease, under two different priors for this: one global and one local in nature. The recurrence score is higher if a gene participates in many samples that do not have too many altered genes, while the focality score is higher if the gene participates in many focal lesions. Besides lending strong support to the inference of a gene as a potential driver, the directionality of the copy number alteration (amplification or deletion) informs us of the likely behavior of the candidate gene as an oncogene or tumor suppressor, respectively.

The genes displayed in FIG. 1 are selected based on the MutComFocal ranking (top 250 genes), the size of minimal region (less than 10 genes) and frequency of mutations (more than 2% for deletion/mutations and at least 1% in amplification/mutations).

RNA-Seq Bioinformatics Analysis.

161 RNA-Seq GBM tumor samples were analyzed from The Cancer Genome Atlas (TCGA), a public repository containing large-scale genome-sequencing of different cancers, plus 24 patients-derived GSCs. Nine of the GSCs samples reported in previous studies were kept in the list to evaluate recurrence[S2]. The samples were analyzed by means of the ChimeraScan[S3] algorithm in order to detect a list of gene fusion candidates. Briefly, ChimeraScan detects those reads that discordantly align to different transcripts of the same reference (split inserts). These reads provide an initial set of putative fusion candidates. Finally, the algorithm realigns the initially unmapped reads to the putative fusion candidates and detects those reads that align across the junction boundary (split reads). These reads provide the genomic coordinates of the breakpoint.

RNA-Seq analysis detected a total of 39,329 putative gene fusion events. In order to focus the experimental analysis on biologically relevant fused transcripts, Pegasus annotation pipeline (http://sourceforge.net/projects/pegasus-fus/) were applied. For each putative fusion, Pegasus reconstructs the entire fusion sequence on the base of genomic fusion breakpoint coordinates and gene annotations. Pegasus also annotates the reading frame of the resulting fusion sequences as either in-frame or frame-shift. Moreover, Pegasus detects the protein domains that are either conserved or lost in the new chimeric event by predicting the amino acid sequence and automatically querying the UniProt web service. On the basis of the Pegasus annotation report, relevant gene fusions were selected for further experimental validation according to the reading frame and the conserved/lost domains. The selected list (FIG. 27) was based on in-frame events expressed by ten or more reads and at least one read spanning the breaking point. To filter out candidate transplicing events, events with putative breakpoints at a distance of at least 25 kb were focused.

EXome-Fuse: Identification of Genetic Rearrangments Using Whole-Exome Data.

Although whole-exome sequencing data contains low intronic coverage that reduces the sensitivity for fusion discovery, it is readily available through the TCGA database. To characterize the genomic breakpoint of the chromosomal rearrangement, EXome-Fuse was designed: a gene fusion discovery pipeline particularly designed to analyze whole-exome data. For the samples harboring EGFR-SEPT14, EGFR-PSPH, NFASC-NTRK1, and BCAN-NTRK1 fusions in RNA, EXome-Fuse was applied to the corresponding whole-exome sequencing data deposited in TCGA. This algorithm can be divided into three stages: split insert identification, split read identification, and virtual reference alignment. Mapping against the human genome reference hg18 with BWA, all split inserts were first identified to compile a preliminary list of fusion candidates. This list was cut of any false positives produced from paralogous gene pairs using the Duplicated Genes Database and the EnsemblCompara GeneTrees[4]. Pseudogenes in the candidate list were annotated using the list from HUGO Gene Nomenclature Committee (HGNC) database[S5] and given lower priority. Candidates were also filtered out between homologous genes, as well as those with homologous or low-complexity regions around the breakpoint. For the remaining fusion candidates, any supporting split reads and their mates were probed using BLAST with a word size of 16, identity cutoff of 90%, and an expectation cutoff of 10'. Finally, a virtual reference was created for each fusion transcript and all reads were re-align to calculate a final tally of split inserts and split reads such that all aligning read pairs maintain F-R directionality.

Targeted Exon Sequencing

All protein-coding exons for the 24 genes of interest were sequenced using genomic DNA extracted from frozen tumors and matched blood. 500 ng of DNA from each sample were sheared to an average of 150 bp in a Covaris instrument for 360 seconds (Duty cycle—10%; intensity—5; cycles/Burst—200). Barcoded libraries were prepared using the Kapa High-Throughput Library Preparation Kit Standard (Kapa Biosystems). Libraries were amplified using the KAPA HiFi Library Amplification kit (Kapa Biosystems) (8 cycles). Libraries were quantified using Qubit Fluorimetric Quantitation (Invitrogen) and the quality and size assessed using an Agilent Bioanalyzer. An equimolar pool of the 4 barcoded libraries (300 ng each) was created and 1,200 ng was input to exon capture using one reaction tube of the custom Nimblegen SeqCap EZ (Roche) with custom probes target the coding exons of the 38 genes. Capture by hybridization was performed according to the manufacturer's protocols with the following modifications: 1 nmol of a pool of blocker oligonucleotides (complementary to the barcoded adapters), and (B) post-capture PCR amplification was done using the KAPA HiFi Library Amplification kit instead of the Phusion High-Fidelity PCR Master Mix with HF Buffer Kit, in a 60 µl volume, since the Kapa HiFi kit greatly reduced or eliminated the bias against GC-rich regions. The pooled capture library was quantified by Qubit (Invitrogen) and Bioanalyzer (Agilent) and sequenced in on an Illumina MiSeq sequencer using the 2×150 paired-end cycle protocol. Reads were aligned to the hg19 build of the human genome using BWA with duplicate removal using samtools as implemented by Illumina MiSeq Reporter. Variant detection was performed using GATK UnifiedGenotyper. Somatic mutations were identified for paired samples using SomaticSniper and filtered for frequency of less than 3% in normal and over 3% in tumor samples. Variants were annotated with Charity annotator to identify protein-coding changes and cross-referenced against known dbSNP, 1000 Genomes, and COSMIC mutations. Sanger sequencing was used to confirm each mutation from normal and tumor DNA.

Modeling of LZTR-1

Structural templates for the Kelch and BTB-BACK regions of human LZTR-1 were identified with HHpred[S6]. An initial 3D model was generated with the I-TASSER server[S7]. The Cul3 N-terminal domain was docked onto the model by superposing the KLHL3$^{BTB-BACK}$/Cul3$^{NTD}$ crystal structure (PDB ID 4HXI, Xi and Privé PLOS ONE 2013) onto the second LZTR-1 BTB-BACK domain. The model does not include higher quaternary structure, although many BTB domains, and many Kelch domains, are known to self-associate[S8]. The short linkage between the end of the first BACK domain and the beginning of the second BTB domain would appear to preclude an intrachain BTB-BTB pseudo-homodimer; without being bound by theory, LZTR-1 self-associates and forms higher order assemblies. Both BACK domains are the shorter, atypical form of the domain and consist of 2 helical hairpin motifs, as in SPOP[S9, S10], and not the 4-hairpin motif seen most BTB-BACK-Kelch proteins[S10, S11] The model from the Kelch domain predicts an unusual 1+3 velcro arrangements[S12], with the N-terminal region contributing strand d of blade 1 and the C-terminal region contributing strands a,b,c of the same blade, although an alternative 2+2 velcro model cannot be ruled out.

Cell Culture

SNB19 and U87 cells were cultured in DMEM supplemented with 10% Fetal Bovine Serum. Growth rate was determined by plating cells in six-well plates post 3 days after infection with the lentivirus indicated in Figure Legends. The number of viable cells was determined by trypan blue exclusion in triplicate cultures obtained from triplicate independent infections. Migration was evaluated by Confluent cells were scratched with a pipette tip and cultured in 0.25% FBS. After 16 h, images were taken using the Olympus IX70 connected to a digital camera. Images were processed using the ImageJ64 software. The area of the cell-free wound was assessed in triplicate samples. Experiments were repeated twice.

Immunofluorescence and Western Blot immunoflurescence staining on brain tumor tissue microarrays were performed as previously described[S17]. Immunofluorescence microscopy was performed on cells fixed with 4% para-formaldehyde (PFA) in phosphate buffer. Cells were permeabilized using 0.2% Triton X 100. Antibodies and concentrations used in immunofluorescence staining are:

| B-III Tubulin | Mouse | 1:400 | Promega |
| Catenin D2 | Guinea Pig | 1:500 | Acris |
| Fibronectin | Mouse | 1:1,000 | BD-Pharmingen |
| PSD-95 | Rabbit | 1:500 | Invitrogen |

Secondary antibodies conjugated to Alexa Fluor 594 (Molecular Probes) were used. DNA was stained by DAPI (Sigma). Fluorescence microscopy was performed on a Nikon AIR MP microscope.

Western blot analysis of U87 cells transduced with pLOC-GFP or pLOC CTNND2 was performed using the following antibodies:

| Anti-Vinculin | Mouse | 1:400 | SIGMA |
| Anti-N-Cadherin | Mouse | 1:200 | BD-Pharmingen |
| Cyclin A | Rabbit | 1:500 | Santa Cruz |
| P27 | Mouse | 1:250 | BD Transduction |

Cloning and Lentiviral Production

The lentiviral expression vector, pLOC-GFP and pLOC-LZTR1 were purchased from Open Biosystems. The full length EGFR-SEPT14 cDNA was amplified from tumor sample TCGA-27-1837. Primers used were: EGFR FW: 5'-agcgATGCGACCCTCCGGGA-3' (SEQ ID NO: 30) and SEPT14 REV: 5'-TCTTACGATGTTTGTCTTTCTTTGT (SEQ ID NO: 31); EGFR wild type, EGFR Viii and EGFR-SEPT14 cDNAs were cloned into pLoc and lentiviral particles were produced using published protocols[S13-S15].

Genomic and mRNA RT-PCR

Total RNA was extracted from cells by using RNeasy Mini Kit (QIAGEN), following the manufacturer instructions. 500 ng of total RNA was retro-transcribed by using the Superscript III kit (Invitrogen), following the manufacturer instructions. The cDNAs obtained after the retro-transcription was used as templates for qPCR as described[S13, S15]. The reaction was performed with a Roche480 thermal cycler, using the Absolute Blue QPCR SYBR Green Mix from Thermo Scientific. The relative amount of specific mRNA was normalized to GAPDH. Results are presented as the mean±SD of triplicate amplifications. The validation of fusion transcripts was performed using both genomic and RT-PCR with forward and reverse primer combinations designed within the margins of the paired-end read sequences detected by RNA-seq. Expressed fusion transcript variants were subjected to direct sequencing to confirm sequence and translation frame. Primers used for the screening of gene fusions are:

```
hEGFR-RT-FW1:
                                    (SEQ ID NO: 32)
5'- GGGTGACTGTTTGGGAGTTGATG -3';

hSEP14-RT-REV1:
                                    (SEQ ID NO: 33)
5'- TGTTTGTCTTTCTTTGTATCGGTGC-3';

hEGFR-RT-FW1:
                                    (SEQ ID NO: 34)
5'- GTGATGTCTGGAGCTACGGG-3';

hPSPH-RT-REV1:
                                    (SEQ ID NO: 35)
5'- TGCCTGATCACATTTCCTCCA-3';

hNFASC-RT-FW1:
                                    (SEQ ID NO: 36)
5'- AGTTCCGTGTCATTGCCATCAAC-3';

hNTRK1-RT-REV1:
                                    (SEQ ID NO: 37)
5'- TGTTTCGTCCTTCTTCTCCACCG-3';

hCAND1-RT-FW1:
                                    (SEQ ID NO: 38)
5'- GGAAAAAATGACATCCAGCGAC-3';

hEGFR-RT-REV1:
                                    (SEQ ID NO: 39)
5'- TGGGTGTAAGAGGCTCCACAAG-3'.
```

Primers used for genomic detection of gene fusions are:

```
genomic EGFR-FW1:
                                    (SEQ ID NO: 40)
5'- GGATGATAGACGCAGATAGTCGCC-3';

genomic SEPT14-REV1:
                                    (SEQ ID NO: 41)
5'- TCCAGTTGTTTTTTCTCTTCCTCG-3';

genomic NFASC-FW1:
                                    (SEQ ID NO: 42)
5'- AAGGGAGAGGGGACCAGAAAGAAC -3';

genomic NTRK1-REV1:
                                    (SEQ ID NO: 43)
5'- GAAAGGAAGAGGCAGGCAAAGAC -3';

genomic CAND1-FW1:
                                    (SEQ ID NO: 44)
5'- GCAATAGCAAAACAGGAAGATGTC-3';

genomic EGFR-REV1:
                                    (SEQ ID NO: 45)
5'- GAACACTTACCCATTCGTTGG-3'.
```

Subcutaneous Xenografts and Drug Treatment

Female athymic mice (nu/nu genotype, Balb/c background, 6 to 8 weeks old) were used for all antitumor studies. Patient-derived adult human glioblastoma xenografts were maintained. Xenografts were excised from host mice under sterile conditions, homogenized with the use of a tissue press/modified tissue cytosieve (Biowhitter Inc, Walkersville, Md.) and tumor homogenate was loaded into a repeating Hamilton syringe (Hamilton, Co., Reno, Nev.) dispenser. Cells were injected sub-cutaneously into the right flank of the athymic mouse at an inoculation volume of 50 μl with a 19-gauge needle[S16]. Subcutaneous tumors were measured twice weekly with hand-held vernier calipers (Scientific Products, McGraw, Ill.). Tumor volumes, V were calculated with the following formula: [(width)$^2$×(length)]/2=V (mm$^3$). For the sub-cutaneously tumor studies, groups of mice randomly selected by tumor volume were treated with EGFR kinase inhibitors when the median tumor volumes were on average 150 mm$^3$ and were compared with control animals receiving vehicle (saline). Erlotinib was administered at 100 mg/Kg orally daily for 10 days. Lapatinib was administered at 75 mg/Kg orally twice per day for 20 days. Response to treatment was assessed by delay in tumor growth and tumor regression. Growth delay, expressed as T-C, is defined as the difference in days between the median time required for tumors in treated and control animals to reach a volume five times greater than that measured at the start of the treatment. Tumor regression is defined as a decrease in tumor volume over two successive measurements. Statistical analysis was performed using a SAS statistical analysis program, the Wilcoxon rank order test for growth delay, and Fisher's exact test for tumor regression as previously described.

REFERENCES

1 Porter, K. R., McCarthy, B. J., Freels, S., Kim, Y. & Davis, F. G. Prevalence estimates for primary brain tumors in the United States by age, gender, behavior, and histology. *Neuro-oncology* 12, 520-527, doi:10.1093/neuonc/nop066 (2010).

2 Stupp, R. et al. Radiotherapy plus concomitant and adjuvant temozolomide for glioblastoma. *The New England journal of medicine* 352, 987-996, doi:10.1056NEJ-Moa043330 (2005).

3 Cancer Genome Atlas Research, N. Comprehensive genomic characterization defines human glioblastoma genes and core pathways. *Nature* 455, 1061-1068, doi:10.1038/nature07385 (2008).

4 Noushmehr, H. et al. Identification of a CpG island methylator phenotype that defines a distinct subgroup of glioma. *Cancer Cell* 17, 510-522, doi:10.1016/j.ccr.2010.03.017 (2010).

5 Parsons, D. W. et al. An integrated genomic analysis of human glioblastoma multiforme. *Science* 321, 1807-1812, doi:10.1126/science.1164382 (2008).

6 Verhaak, R. G. et al. Integrated genomic analysis identifies clinically relevant subtypes of glioblastoma characterized by abnormalities in PDGFRA, IDH1, EGFR, and NF1. *Cancer Cell* 17, 98-110, doi:10.1016/j.ccr.2009.12.020 (2010).

7 Bass, A. J. et al. Genomic sequencing of colorectal adenocarcinomas identifies a recurrent VT11A-TCF7L2 fusion. *Nat Genet* 43, 964-968, doi:10.1038/ng.936 (2011).

8 Chinnaiyan, A. M. & Palanisamy, N. Chromosomal aberrations in solid tumors. *Prog Mol Biol Transl Sci* 95, 55-94, doi:10.1016/B978-0-12-385071-3.00004-6 (2010).

9 Singh, D. et al. Transforming fusions of FGFR and TACC genes in human glioblastoma. *Science* 337, 1231-1235, doi:10.1126/science.1220834 (2012).

10 Rubin, A. F. & Green, P. Mutation patterns in cancer genomes. *Proc Natl Acad Sci USA* 106, 21766-21770, doi:10.1073/pnas.0912499106 (2009).

11 Fan, Z. et al. BCOR regulates mesenchymal stem cell function by epigenetic mechanisms. *Nat Cell Biol* 11, 1002-1009, doi:10.1038/ncb1913 (2009).

12 Wamstad, J. A. & Bardwell, V. J. Characterization of Bcor expression in mouse development. *Gene Expr Patterns* 7, 550-557, doi:10.1016/j.modgep.2007.01.006 (2007).

13 Wamstad, J. A., Corcoran, C. M., Keating, A. M. & Bardwell, V. J. Role of the transcriptional corepressor Bcor in embryonic stem cell differentiation and early embryonic development. *PLoS One* 3, e2814, doi: 10.1371/journal.pone.0002814 (2008).
14. Pugh, T. J. et al. Medulloblastoma exome sequencing uncovers subtype-specific somatic mutations. *Nature* 488, 106-110, doi:10.1038/nature11329 (2012).
15. Zhang, J. et al. A novel retinoblastoma therapy from genomic and epigenetic analyses. *Nature* 481, 329-334, doi:10.1038/nature10733 (2012).
16. Beroukhim, R. et al. The landscape of somatic copy-number alteration across human cancers. *Nature* 463, 899-905, doi:10.1038/nature08822 (2010).
17. Kantarci, S. et al. Mutations in LRP2, which encodes the multiligand receptor megalin, cause Donnai-Barrow and facio-oculo-acoustico-renal syndromes. *Nat Genet* 39, 957-959, doi:10.1038/ng2063 (2007).
18. Willnow, T. E. et al. Defective forebrain development in mice lacking gp330/megalin. *Proc Natl Acad Sci USA* 93, 8460-8464 (1996).
19. Christ, A. et al. LRP2 is an auxiliary SHH receptor required to condition the forebrain ventral midline for inductive signals. *Dev Cell* 22, 268-278, doi:10.1016/j.devcel.2011.11.023 (2012).
20. Cowin, P. A. et al. LRP1B deletion in high-grade serous ovarian cancers is associated with acquired chemotherapy resistance to liposomal doxorubicin. *Cancer Res* 72, 4060-4073, doi:10.1158/0008-5472.CAN-12-0203 (2012).
21. Lima, F. R. et al. Glioblastoma: therapeutic challenges, what lies ahead. *Biochim Biophys Acta* 1826, 338-349, doi:10.1016/j.bbcan.2012.05.004 (2012).
22. Bekker-Jensen, S. et al. HERC2 coordinates ubiquitin-dependent assembly of DNA repair factors on damaged chromosomes. *Nat Cell Biol* 12, 80-86; sup pp 81-12, doi:10.1038/ncb2008 (2010).
23. Harlalka, G. V. et al. Mutation of HERC2 causes developmental delay with Angelman-like features. *J Med Genet* 50, 65-73, doi:10.1136/jmedgenet-2012-101367 (2013).
24. Nacak, T. G., Leptien, K., Fellner, D., Augustin, H. G. & Kroll, J. The BTB-kelch protein LZTR-1 is a novel Golgi protein that is degraded upon induction of apoptosis. *J Biol Chem* 281, 5065-5071, doi:10.1074/jbc.M509073200 (2006).
25. Stogios, P. J., Downs, G. S., Jauhal, J. J., Nandra, S. K. & Prive, G. G. Sequence and structural analysis of BTB domain proteins. *Genome Biol* 6, R82, doi:10.1186/gb-2005-6-10-r82 (2005).
26. Errington, W. J. et al. Adaptor protein self-assembly drives the control of a cullin-RING ubiquitin ligase. *Structure* 20, 1141-1153, doi:10.1016/j.str.2012.04.009 (2012).
27. Canning, P. et al. Structural basis for Cul3 assembly with the BTB-Kelch family of E3 ubiquitin ligases. *J Biol Chem*, doi:10.1074/jbc.M112.437996 (2013).
28. Lo, S. C., Li, X., Henzl, M. T., Beamer, L. J. & Hannink, M. Structure of the Keap1:Nrf2 interface provides mechanistic insight into Nrf2 signaling. *EMBO J* 25, 3605-3617, doi:10.1038/sj.emboj.7601243 (2006).
29. Boyden, L. M. et al. Mutations in kelch-like 3 and cullin 3 cause hypertension and electrolyte abnormalities. *Nature* 482, 98-102, doi:10.1038/nature10814 (2012).
30. Louis-Dit-Picard, H. et al. KLHL3 mutations cause familial hyperkalemic hypertension by impairing ion transport in the distal nephron. *Nat Genet* 44, 456-460, S451-453, doi:10.1038/ng.2218 (2012).
31. Abu-Elneel, K. et al. A delta-catenin signaling pathway leading to dendritic protrusions. *J Biol Chem* 283, 32781-32791, doi:10.1074/jbc.M804688200 (2008).
32. Arikkath, J. et al. Delta-catenin regulates spine and synapse morphogenesis and function in hippocampal neurons during development. *J Neurosci* 29, 5435-5442, doi:10.1523/JNEUROSCI.0835-09.2009 (2009).
33. Kosik, K. S., Donahue, C. P., Israely, I., Liu, X. & Ochiishi, T. Delta-catenin at the synaptic-adherens junction. *Trends Cell Biol* 15, 172-178, doi:10.1016/j.tcb.2005.01.004 (2005).
34. Israely, I. et al. Deletion of the neuron-specific protein delta-catenin leads to severe cognitive and synaptic dysfunction. *Curr Biol* 14, 1657-1663, doi:10.1016/j.cub.2004.08.065 (2004).
35. Jun, G. et al. delta-Catenin is genetically and biologically associated with cortical cataract and future Alzheimer-related structural and functional brain changes. *PLoS One* 7, e43728, doi:10.1371/journal.pone.0043728 (2012).
36. Hicks, S., Wheeler, D. A., Plon, S. E. & Kimmel, M. Prediction of missense mutation functionality depends on both the algorithm and sequence alignment employed. *Hum Mutat* 32, 661-668, doi:10.1002/humu.21490 (2011).
37. Phillips, H. S. et al. Molecular subclasses of high-grade glioma predict prognosis, delineate a pattern of disease progression, and resemble stages in neurogenesis. *Cancer Cell* 9, 157-173, doi:10.1016/j.ccr.2006.02.019 (2006).
38. Pierotti, M. A. & Greco, A. Oncogenic rearrangements of the NTRK1/NGF receptor. *Cancer Lett* 232, 90-98, doi: 10.1016/j.canlet.2005.07.043 (2006).
39. Dunn, G. P. et al. Emerging insights into the molecular and cellular basis of glioblastoma. *Genes Dev* 26, 756-784, doi:10.1101/gad.187922.112 (2012).
40. Vivanco, I. et al. Differential sensitivity of glioma-versus lung cancer-specific EGFR mutations to EGFR kinase inhibitors. *Cancer Discov* 2, 458-471, doi:10.1158/2159-8290.CD-11-0284 (2012).
41. Forbes, S. A. et al. COSMIC (the Catalogue of Somatic Mutations in Cancer): a resource to investigate acquired mutations in human cancer. *Nucleic Acids Res* 38, D652-657, doi:10.1093/nar/gkp995 (2010).
42. Northcott, P. A. et al. Subgroup-specific structural variation across 1,000 medulloblastoma genomes. *Nature* 488, 49-56, doi:10.1038/nature11327 (2012).
43. Tiacci, E. et al. BRAF mutations in hairy-cell leukemia. *The New England journal of medicine* 364, 2305-2315, doi:10.1056/NEJMoa1014209 (2011).
44. Iyer, M. K., Chinnaiyan, A. M. & Maher, C. A. ChimeraScan: a tool for identifying chimeric transcription in sequencing data. *Bioinformatics* 27, 2903-2904, doi: 10.1093/bioinformatics/btr467 (2011).
S1. Tiacci, E. et al. BRAF mutations in hairy-cell leukemia. *The New England journal of medicine* 364, 2305-2315, doi:10.1056/NEJMoa1014209 (2011).
S2. Singh, D. et al. Transforming fusions of FGFR and TACC genes in human glioblastoma. *Science* 337, 1231-1235, doi:10.1126/science.1220834 (2012).
S3. Iyer, M. K., Chinnaiyan, A. M. & Maher, C. A. ChimeraScan: a tool for identifying chimeric transcription in sequencing data. *Bioinformatics* 27, 2903-2904, doi: 10.1093/bioinformatics/btr467 (2011).
S4. Vilella, A. J. et al. EnsemblCompara GeneTrees: Complete, duplication-aware phylogenetic trees in vertebrates. *Genome Res* 19, 327-335, doi:10.1101/gr.073585.107 (2009).

S5 Seal, R. L., Gordon, S. M., Lush, M. J., Wright, M. W. & Bruford, E. A. genenames.org: the HGNC resources in 2011. *Nucleic Acids Res* 39, D514-519, doi:10.1093/nar/gkq892 (2011).

S6 Soding, J. Protein homology detection by HMM-HMM comparison. *Bioinformatics* 21, 951-960, doi:10.1093/bioinformatics/bti125 (2005).

S7 Roy, A., Kucukural, A. & Zhang, Y. I-TASSER: a unified platform for automated protein structure and function prediction. *Nat Protoc* 5, 725-738, doi:10.1038/nprot.2010.5 (2010).

S8 Stogios, P. J., Downs, G. S., Jauhal, J. J., Nandra, S. K. & Prive, G. G. Sequence and structural analysis of BTB domain proteins. *Genome Biol* 6, R82, doi:10.1186/gb-2005-6-10-r82 (2005).

S9 Errington, W. J. et al. Adaptor protein self-assembly drives the control of a cullin-RING ubiquitin ligase. *Structure* 20, 1141-1153, doi:10.1016/j.str.2012.04.009 (2012).

S10 Zhuang, M. et al. Structures of SPOP-substrate complexes: insights into molecular architectures of BTB-Cul3 ubiquitin ligases. *Mol Cell* 36, 39-50, doi:10.1016/j.molcel.2009.09.022 (2009).

S11 Canning, P. et al. Structural basis for Cul3 assembly with the BTB-Kelch family of E3 ubiquitin ligases. *J Biol Chem*, doi:10.1074/jbc.M112.437996 (2013).

S12 Fulop, V. & Jones, D. T. Beta propellers: structural rigidity and functional diversity. *Curr Opin Struct Biol* 9, 715-721 (1999).

S13 Carro, M. S. et al. The transcriptional network for mesenchymal transformation of brain tumours. *Nature* 463, 318-325, doi:10.1038/nature08712 (2010).

S14 Niola, F. et al. Mesenchymal high-grade glioma is maintained by the ID-RAP1 axis. *J Clin Invest* 123, 405-417, doi:10.1172/JCI63811 (2013).

S15 Zhao, X. et al. The N-Myc-DLL3 cascade is suppressed by the ubiquitin ligase Huwel to inhibit proliferation and promote neurogenesis in the developing brain. *Dev Cell* 17, 210-221, doi:10.1016/j.devcel.2009.07.009 (2009).

S16 Friedman, H. S. et al. Experimental chemotherapy of human medulloblastoma cell lines and transplantable xenografts with bifunctional alkylating agents. *Cancer Res* 48, 4189-4195 (1988).

S17 Srivastava, M. et al. The *Amphimedon queenslandica* genome and the evolution of animal complexity. *Nature* 466, 720-726, doi:10.1038/nature09201 (2010).

S18 Sebe-Pedros, A., Roger, A. J., Lang, F. B., King, N. & Ruiz-Trillo, I. Ancient origin of the integrin-mediated adhesion and signaling machinery. *Proc Natl Acad Sci USA* 107, 10142-10147, doi:10.1073/pnas.1002257107 (2010).

Example 2—Genomic Alterations in Glioblastoma

Glioblastoma remains one of the most challenging forms of cancer to treat. This example discusses a computational platform that integrates the analysis of copy number variations and somatic mutations and unravels the landscape of in frame gene fusions in glioblastoma. Mutations were found with loss of heterozygosity of LZTR-1, an adaptor of Cul3-containing E3 ligase complexes. Mutations and deletions disrupt LZTR-1 function, which restrains self-renewal and growth of glioma spheres retaining stem cell features. Loss-of-function mutations of CTNND2 target a neural-specific gene and are associated with transformation of glioma cells along the very aggressive mesenchymal phenotype. Recurrent translocations are reported that fuse the coding sequence of EGFR to several partners, with EGFR-SEPT14 as the most frequent functional gene fusion in human glioblastoma. EGFR-SEPT14 fusions activate Stat3 signaling and confer mitogen independency and sensitivity to EGFR inhibition. These results provide important insights into the pathogenesis of glioblastoma and highlight new targets for therapeutic intervention.

Glioblastoma (GBM) is the most common primary intrinsic malignant brain tumor affecting ~10,000 new patients each year with a median survival rate of 12-15 months[1,2]. Identifying and understanding the functional significance of genetic alterations that drive initiation and progression of GBM is crucial to develop effective therapies. Previous efforts in GBM genome characterization identified somatic changes in well-known GBM genes (EGFR, PTEN, IDH1, TP53, NF1, etc.) and nominated putative cancer genes with somatic mutations, but the functional consequence of most alterations is unknown[3-6]. Furthermore, the abundance of passenger mutations and large regions of copy number variations (CNVs) complicates the definition of the landscape of driver mutations in glioblastoma. To address this challenge, a statistical approach was used to nominate driver genes in GBM by integrating somatic mutations identified by whole-exome sequencing with a CNVs analysis that prioritizes focality and magnitude of the genetic alterations.

Recurrent and oncogenic gene fusions are hallmarks of hematological malignancies and have also been uncovered in solid tumors[7,8]. Recently, a small subset of GBM harbor FGFR-TACC gene fusions was reported indicating that the patients with FGFR-TACC-positive tumors would benefit from targeted FGFR kinase inhibition. It remains unknown whether gene fusions involving other RTK-coding genes exist and produce oncogene addiction in GBM. Here, a large RNA-sequencing dataset of primary GBM and Glioma Sphere Cultures (GSCs) is investigated and the global landscape of in frame gene fusions in human GBM are reported.

Nomination of Candidate GBM Genes

Without being bound by theory, integration of somatic point mutations and focal CNVs will uncover candidate driver GBM genes. MutComFocal is an algorithm designed to rank genes by an integrated recurrence, focality and mutation score (see Methods). This strategy was applied to 139 GBM and matched normal DNA analyzed by whole-exome sequencing to identify somatic mutations and 469 GBM analyzed by the Affymetrix SNP6.0 platform to identify CNVs.

The whole-exome analysis revealed a mean of 43 non-synonymous somatic mutations per tumor sample. The distribution of substitutions shows a higher rate of transitions versus tranversions (67%), with a strong preference for C→T and G→A (55%) (FIG. 6). As seen in other tumor types[10], 19.2% of the mutations occurred in a CpG dinucleotide context (FIG. 7). Among somatic small nucleotide variants, the most frequently mutated genes have roles in cancer, including GBM (TP53, EGFR, PTEN, and IDH1). In addition to known cancer genes, new candidate driver genes were mutated in ~5% of tumor samples. By integrating mutational and common focal genomic lesions, MutComFocal stratified somatically mutated genes into three groups: recurrently mutated genes without significant copy number alterations (Mut), in regions of focal and recurrent amplifications (Amp-Mut) and in regions of focal and recurrent deletions (Del-Mut).

Figure 2C:
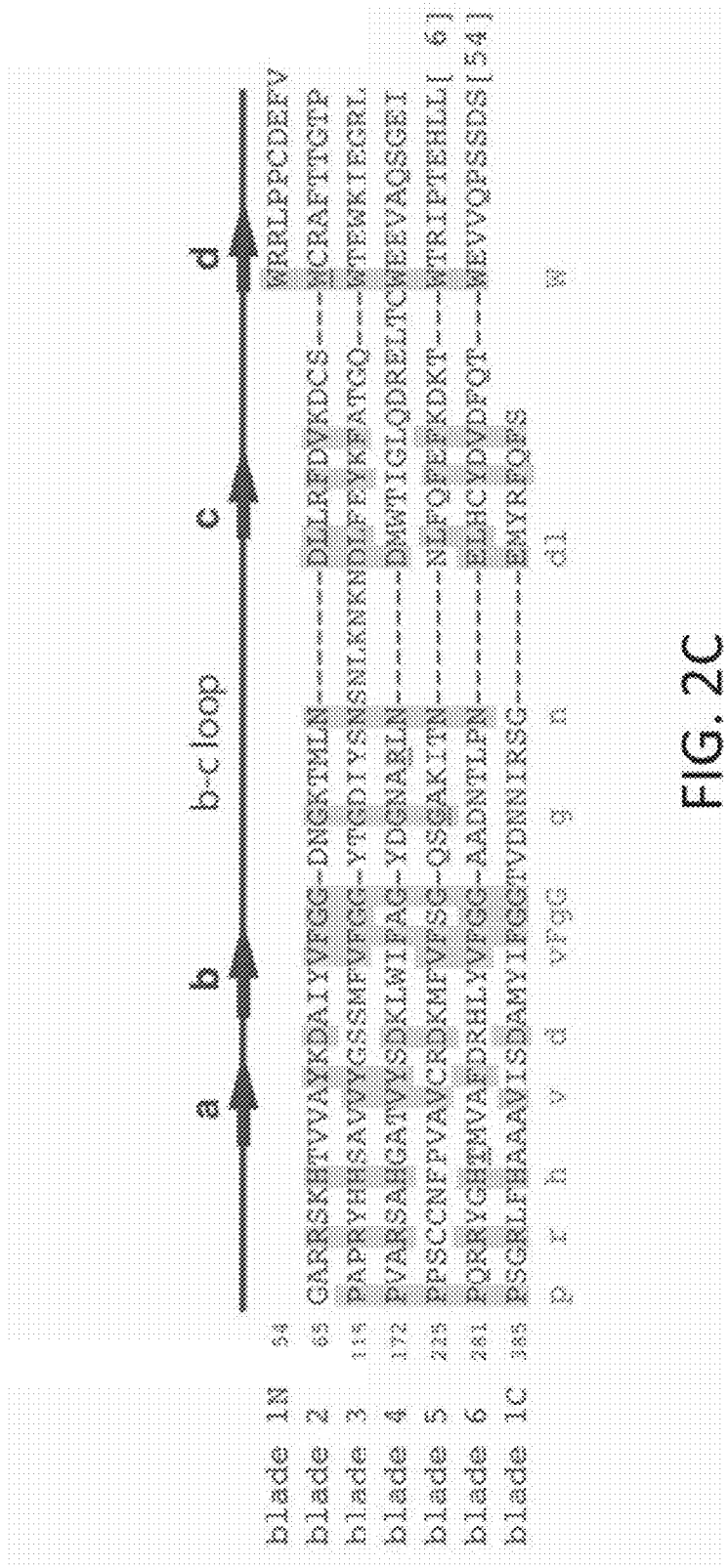
FIG. 2C. Sequence alignment of the six blades from the Kelch β-propeller domain. Each blade contains four core β-strands, labeled a, b, c, d. Conserved residues are highlighted in gray and residues mutated in GBM are shown in red. Insertions at the end of blades 5 and 6 are indicated in brackets. Figure discloses SEQ ID NO: 8478.

A list of 67 genes were generated that score at the top of each of the three categories and included nearly all the genes previously implicated in GBM. Among these genes, (labeled in light grey in FIG. 1) are IDH1 (Mut, FIG. 1a), PIK3C2B, MDM4, MYCN, PIK3CA, PDGFRA, KIT, EGFR, and BRAF (Amp-Mut, FIG. 1b) and PIK3R1, PTEN, RB1, TP53, NF1 and ATRX (Del-Mut, FIG. 1c). The analysis also selected 52 new candidate driver genes previously unreported in GBM. Based upon their role in CNS development and homeostasis as well as their potential function in gliomagenesis, 24 genes were selected for re-sequencing in an independent dataset of 83 GBM and matched normal controls. Eighteen genes were found somatically mutated by Sanger sequencing in the independent panel (labeled in dark grey in FIG. 1). Each validated new GBM gene is targeted by somatic mutations and CNVs in a cumulative fraction comprised between 2.9% and 45.7% of GBM. Furthermore, mutations of the 18 new GBM genes occur mostly in tumors with global mutation rates similar to the mean of 43 mutations per tumor and well within the 95% confidence interval, indicating that mutations of the 18 new genes do not cluster in hypermutated tumors (FIG. 2C and FIG. 9).

Among the commonly mutated and focally deleted genes exhibiting top MutComFocal scores and validated in the independent GBM dataset, BCOR, LRP family members, HERC2, LZTR-1 and CTNND2. BCOR, an X-linked gene, encodes for a component of the nuclear co-repressor complex that is essential for normal development of neuroectoderm and stem cell functions[11-13]. BCOR mutations have recently been described in retinoblastoma and medulloblastoma[14,15]. LRPIB, a member of the LDL receptor family, is among the most frequently mutated genes in human cancer (FIG. 1c)[16]. Interestingly, two other LDL receptor family members (LRP2 and LRP1) are mutated in 4.4% and 2.9% of tumors, respectively (FIG. 1a). The LRP proteins are highly expressed in the neuroepithelium and are essential for forebrain morphogenesis in mouse and humans[17,18]. The tumor suppressor function of LRP proteins in GBM may relate to the ability to promote chemosensitivity and control in the Sonic hedgehog signaling pathway, which is implicated in cancer initiating cells in GBM[19-21]. Localized on chromosome 15q13, the Hect ubiquitin ligase Herc2 gene is deleted and mutated in 15.1% and 2.2% of GBM cases, respectively. Herc2 has been implicated in severe neurodevelopmental syndromes and Herc2 substrates regulate genome stability and DNA damage-repair[22,23].

LZTR-1 Mutations Inactivate a Cullin-3 Adaptor to Drive Self-Renewal and Growth of Glioma Spheres A gene that received one of the highest Del-Mut score by MutComFocal is LZTR-1 (FIG. 1c). The LZTR-1 coding region had non-synonymous mutations in 4.4%, and the LZTR-1 locus (human chromosome 22q11) was deleted in 22.4% of GBM. Among the 18 new GBM genes, LZTR-1 had the highest co-occurrence score of mutations and deletions (Fisher's exact test, p=0.0007). It also scored at the top of the list of genes whose CNVs are statistically correlated with expression (Pearson correlation between LZTR-1 CNVs and expression is 0.36, p-value<$10^{-6}$ by Student's t-distribution). Finally, LZTR-1 emerged as the gene with the highest correlation for monoallelic expression of mutant alleles in tumors harboring LZTR-1 deletions (p-value=0.0007). Taken together, these findings indicate that LZTR-1 is concurrently targeted in GBM by mutations and copy number loss, fulfilling the two-hits model for tumor suppressor inactivation in cancer.

Figure 15:
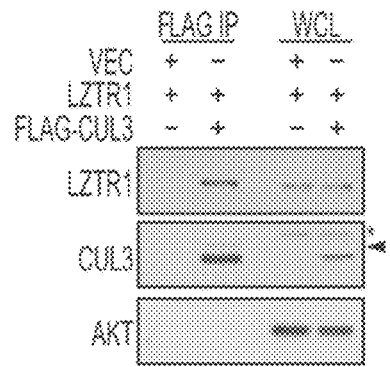
FIG. 15 is a photographic image of a blot showing the interaction with Cul3 and protein stability of wild type and mutant LZTR-1. Lysates from SF188 glioma cells transfected with vectors expressing Myc-LZTR-1 and Flag-Cul3 or the empty vector were immunoprecipitated with Flag antibody and assayed by western blot with the indicated antibodies. *, non specific band; arrowhead indicates neddylated Cul3.

LZTR-1 codes for a protein with a characteristic Kelch-BTB-BACK-BTB-BACK domain architecture (FIGS. 2C, 8, 9) and is expressed in normal brain. The LZTR-1 gene is highly conserved in metazoans. Although it was initially proposed that LZTR-1 functions as a transcriptional regulator, this role was not confirmed in follow-up studies[24]. Most proteins with BTB-BACK domains are substrate adaptors in Cullin-3 (Cul3) ubiquitin ligase complexes, in which the BTB-BACK region binds to the N-terminal domain of Cul3, while a ligand binding domain, often a Kelch 6-bladed β-propeller motif, binds to substrates targeted for ubiquitylation[25]. To ask whether LZTR-1 directly binds Cul3, co-immunoprecipitation experiments were performed in human glioma cells. FIG. 15 shows that Cul3 immunoprecipitates contain LZTR-1, indicating that LZTR-1 is an adaptor in Cul3 ubiquitin ligase complexes.

To address the function of LZTR-1 mutants, a homology model of LZTR-1 was built based partly on the crystal structures of the MATH-BTB-BACK protein SPOP[26], the BTB-BACK-Kelch proteins KLHL3[27] and KLHL11[28], and the Kelch domain of Keap1[29] (FIG. 2b). Without being bound by theory, the second BTB-BACK region of LZTR-1 binds Cul3 because of a φ-X-E motif in this BTB domain, followed by a 3-Box/BACK region (FIG. 9)[26]. However, the preceding BTB-BACK region can also participate in Cul3 binding. Five of seven LZTR-1 mutations identified in GBM are located within the Kelch domain and target highly conserved amino acids (FIG. 2b, FIG. 2C, FIG. 8). Interestingly, the concentration of LZTR-1 mutations in the Kelch domain reflects a similar pattern of mutations in the Kelch-coding region of KLHL3, recently identified in families with hypertension and electrolytic abnormalities[30,31].

The R198G and G248R mutations localize to the b-c loop of the Kelch domain, in a region predicted to provide the substrate-binding surface[29]. The W105R mutation targets a highly conserved anchor residue in the Kelch repeats and the T288I mutation disrupts a buried residue conserved in LZTR-1 (FIG. 2b, FIG. 2C, FIG. 8). Both mutations are expected to perturb folding of the Kelch domain. The E353STOP mutation is expected to produce a misfolded Kelch domain besides removing the C-terminal BTB-BACK regions. Located in the BTB-BACK domains, the remaining two mutations either truncate the entire BTB-BACK-BTB-BACK region (W437STOP) or are predicted to disrupt the folding of the last helical hairpin in the BTB-BACK domain (R810W, FIG. 2b).

Figure 16A:
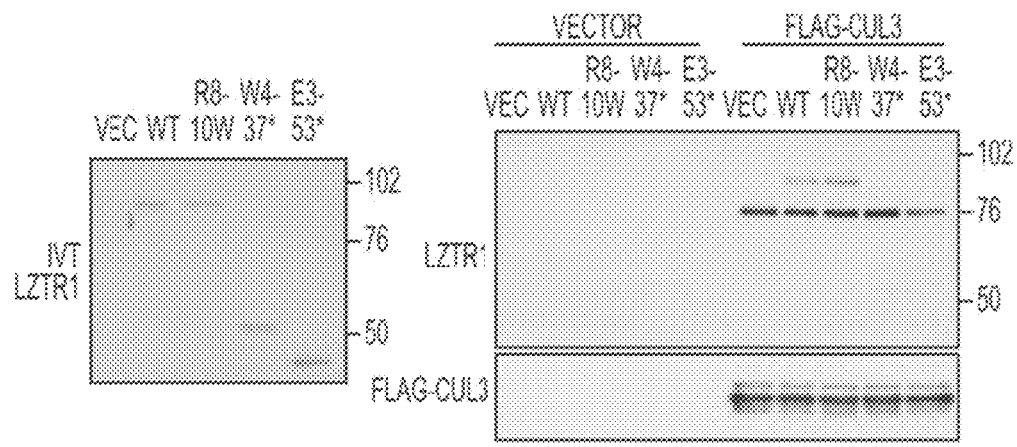
FIG. 16A are a photographic images of a blot showing the interaction with Cul3 and protein stability of wild type and mutant LZTR-1. In vitro analysis of the interaction between Cul3 and LZTR-1 wild type and GBM related mutants. Left panel, In vitro translated Myc-LZTR-1 input. Right panel, In vitro translated Myc-LZTR-1 was mixed with Flag-Cul3 immunoprecipitated from transfected HEK-293T cells. Bound proteins were analyzed by western blot using the indicated antibodies.
Figure 16B:
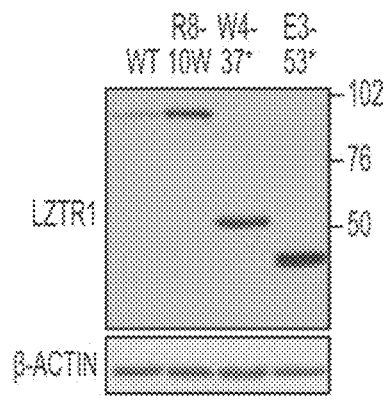
FIG. 16B is a photographic image of a blot showing the interaction with Cul3 and protein stability of wild type and mutant LZTR-1. Steady state protein levels of wild type LZTR-1 and GBM-related mutants.
Figure 16C:
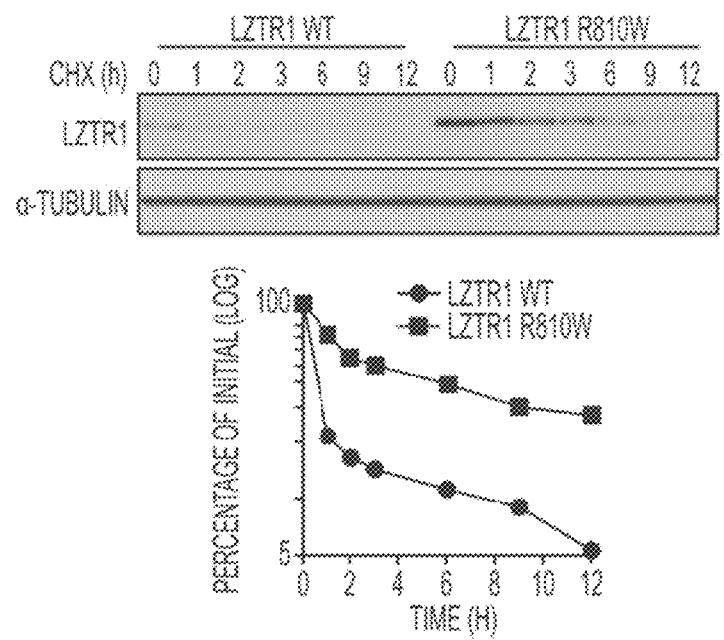
FIG. 16C is a photographic image of a blot (top) and a graph (bottom) Top panel, Cells transfected with LZTR-1 wild type or the R810W mutant were treated with cycloeximide for the indicated time. Bottom panel, Quantification of LZTR-1 wild type and LZTR-1-R810W protein from the experiment in the left panel.
Figure 16D:
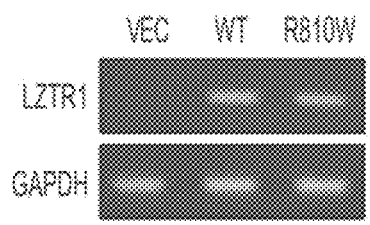
FIG. 16D is a photographic image of a blot showing the interaction with Cul3 and protein stability of wild type and mutant LZTR-1. Semi-quantitative RT-PCR evaluation of LZTR-1 wild type and LZTR-1-R810W RNA expression in cells transfected as in FIG. 16C.

To ask whether the mutations predicted to affect the BTB-BACK domains perturb the interaction with Cul3, in vitro translated wild type, E353STOP, W437STOP and R810W LZTR-1 Myc-tagged proteins were prepared and their ability to bind to Flag-Cul3 purified from mammalian cells was tested. Wild type LZTR-1 bound Flag-Cul3, but the E353STOP and W437STOP mutants lost this property. However, the R810W mutant retained Cul3 binding in this assay (FIG. 16A). Besides promoting ubiquitin-mediated degradation of substrates, Cullin adaptors are short-lived proteins that undergo auto-ubiquitylation and destruction by the same Cullin complexes that direct substrate ubiquitylation[32-34]. Thus, impaired ubiquitin ligase activity of the LZTR-1-Cul3 complex should result in accumulation of mutant LZTR-1 proteins. Each of the three LZTR-1 mutants predicted to compromise integrity of the BTB-BACK domains accumulated at higher levels than wild-type LZTR-1 in transient transfection assays (FIG. 16B). The steady state and half-life of the LZTR-1 R810W mutant protein were markedly increased, in the absence of changes of the mutant mRNA (FIG. 16C-D). Thus, as for the two truncated mutants, the R810W mutation compromised protein degradation.

Figure 17A:
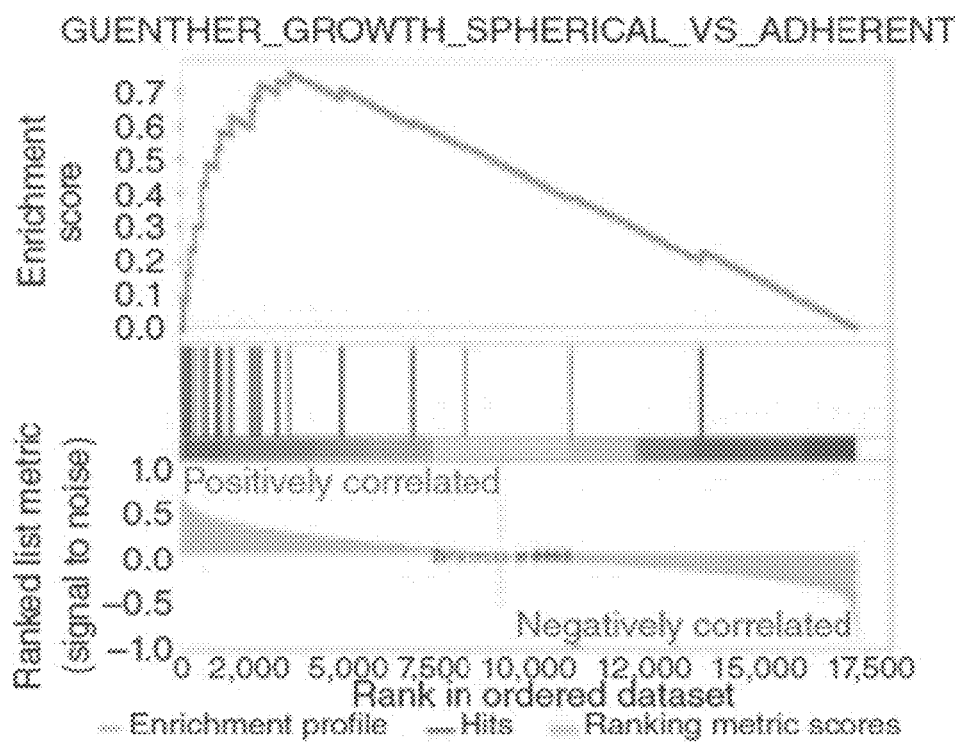
FIG. 17A is a graph showing functional analysis of LZTR-1 wild type and GBM associated mutants in GBM-derived cells. GSEA shows up-regulation of genes associated with the phenotype of "spherical cultures" of glioma cells in primary human GBM carrying mutations in the LZTR-1 gene [Enrichment Score (ES)=0.754; P (family-wise error rate, FWER)=0.000 q (false discovery rate, FDR)=0.000].
Figure 17B:
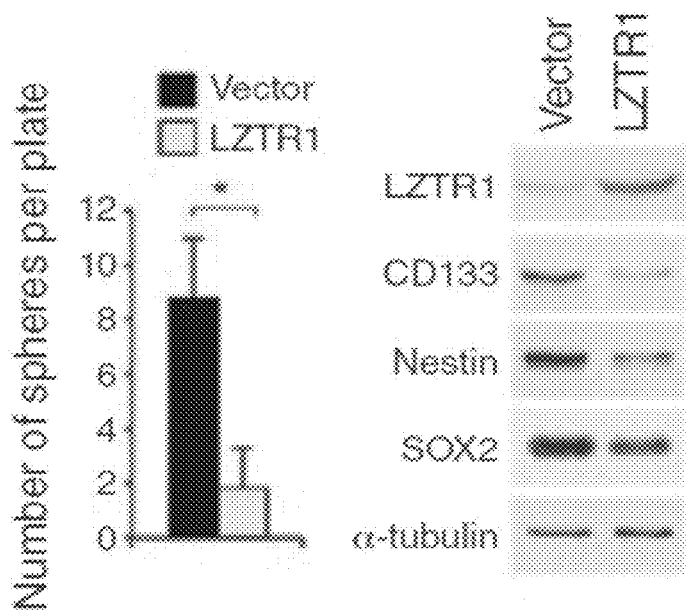
FIG. 17B is a graph showing functional analysis of LZTR-1 wild type and GBM associated mutants in GBM-derived cells. Sphere forming assay (left panel) and western blot analysis (right panel) of GBM-derived glioma spheres (#48) expressing vector or LZTR-1. Data are Mean±SD of triplicate samples (p=0.0036). Error bars are SD.
Figure 17C:
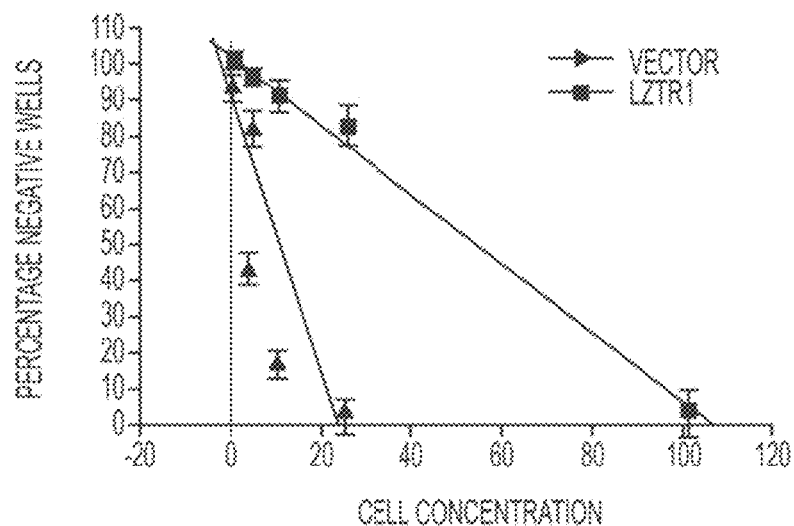
FIG. 17C is a linear regression plot of in vitro limiting dilution assay using GBM-derived glioma spheres #46 expressing vector or LZTR-1. The frequency of sphere forming cells was 8.49±1.04 and 1.44±0.05% in vector and LZTR-1 expressing cells, respectively (p=0.00795). Each data point represents the average of triplicates. Error bars are SD.
Figure 17D:
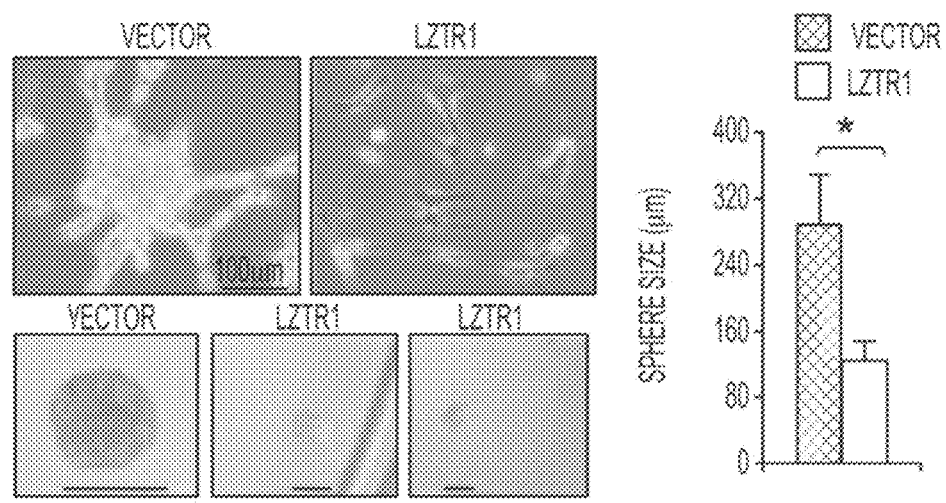
FIG. 17D is a graph and photographic microscopy images showing functional analysis of LZTR-1 wild type and GBM associated mutants in GBM-derived cells. Left upper panels, Bright field microphotographs of GBM-derived line 46 cells six days after transduction with vector or LZTR-1 expressing lentivirus. Left lower panels, Bright field microphotographs of spheres from GBM-derived glioma cells #46 expressing lentivirus expressing vector or LZTR-1 from experiment in FIG. 17C. Right panel, The size of tumor spheres from cultures in c was determined by microscopy review after 14 days of culture. n=60 spheres from triplicates for each condition. Data are Mean±SD (p<0.0001). Error bars are SD.
Figure 17E:
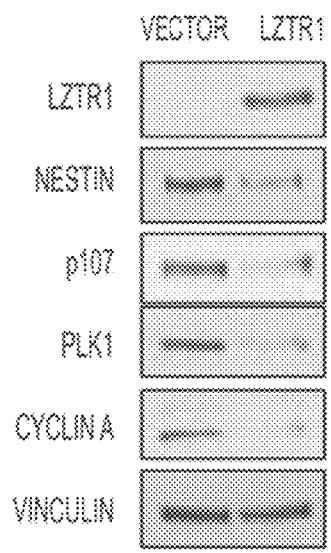
FIG. 17E is a photographic image of a western blot analysis of GBM-derived cells #84 expressing vector or LZTR-1.
Figure 17F:
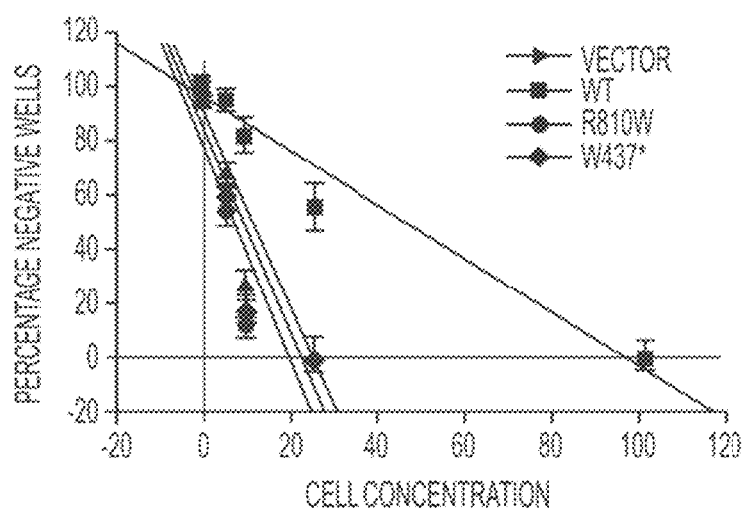
FIG. 17F is a linear regression plot of in vitro limiting dilution assay using GBM-derived line 84 expressing vector, LZTR-1, LZTR-1-R810W or LZTR-1-W437STOP. The frequency of sphere forming cells was 7.2±0.92 for vector, 1.48±0.09 for LZTR-1 wild type (p=0.0096); 7.82±0.99 for LZTR-1-R810W (p=0.2489); and 6.74±1.07 for LZTR-1-W437STOP (p=0.2269). Error bars are SD.

Next, the biological consequences of LZTR-1 inactivation in human GBM. Differential gene expression pattern of GBM harboring mutations was examined and deletions of LZTR-1 or normal LZTR-1 revealed that tumors with genetic inactivation of LZTR-1 were enriched for genes associated with glioma sphere growth and proliferation[35] (FIG. 17A). Introduction of LZTR-1 in three independent GBM-derived sphere cultures resulted in strong inhibition of glioma sphere formation and expression of glioma stem cell markers (FIG. 17B-E). LZTR-1 also decreased the size of tumor spheres, induced a flat and adherent phenotype and reduced proteins associated with cell cycle progression (cyclin A, PLK1, p107, FIG. 17D-E). Interestingly, both R810W and W437STOP LZTR-1 mutations abolished LZTR-1 ability to impair glioma sphere formation (FIG. 17F). The above experiments indicate that LZTR-1 inactivation in human GBM drives self-renewal and growth of glioma spheres.

Inactivation of CTNND2 Induces Mesenchymal Transformation in Glioblastoma

Among the top ranking genes in MutComFocal, CTNND2 is expressed at the highest levels in normal brain. CTNND2 codes for δ-catenin, a member of the p120 subfamily of catenins expressed almost exclusively in the nervous system where it is crucial for neurite elongation, dendritic morphogenesis and synaptic plasticity[36-38]. Germline hemizygous loss of CTNND2 impairs cognitive functions and underlies some forms of mental retardation[39,40]. CTNND2 shows pronounced clustering of mutations in GBM. The observed spectrum of mutations includes four mutations in the armadillo-coding domain and one in the region coding for the N-terminal coiled-coil domain (FIG. 10A), the two most relevant functional domains of δ-catenin. Each mutation targets highly conserved residues with probably (K629Q, A776T, S881L, D999E) and possibly (A71T) damaging consequences[41]. GBM harbors focal genomic losses of CTNND2, and deletions correlate with loss of CTNND2 expression (FIG. 10B).

Figure 18A:
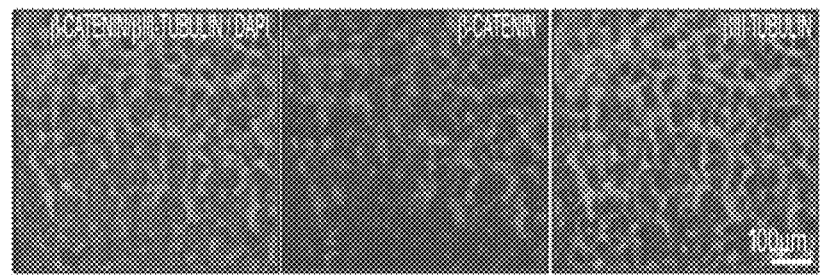
FIGS. 18A-B are photographic microscopy images showing expression of δ-catenin in neurons and δ-catenin driven loss of mesenchymal marker in GBM.
Figure 18B:
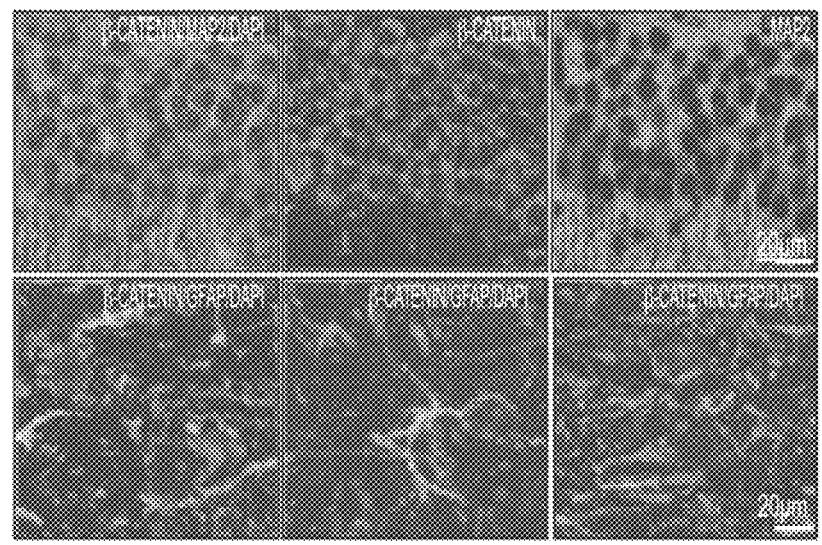
Figure 22A:
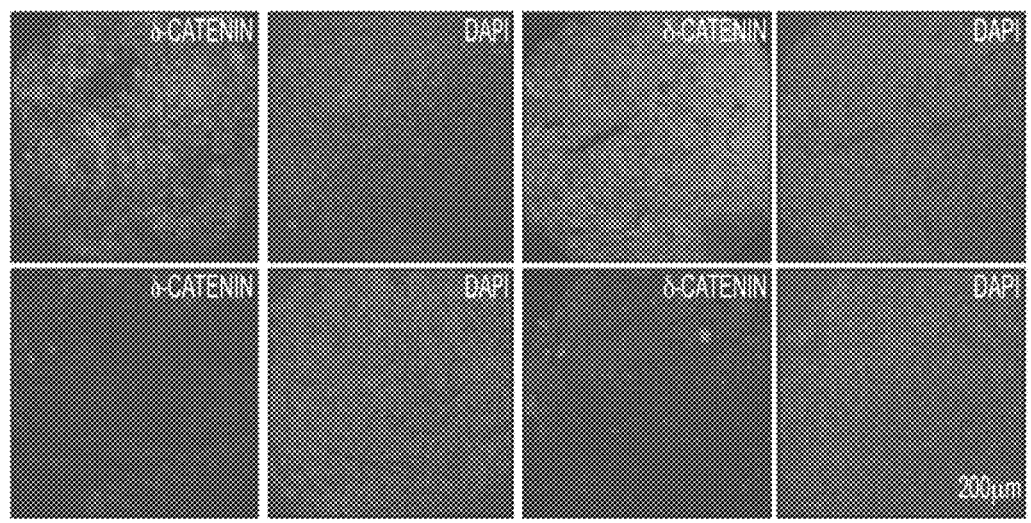
FIGS. 22A-B show pattern of somatic mutations, CNVs and expression of CTNND2 in GBM.
Figure 22B:
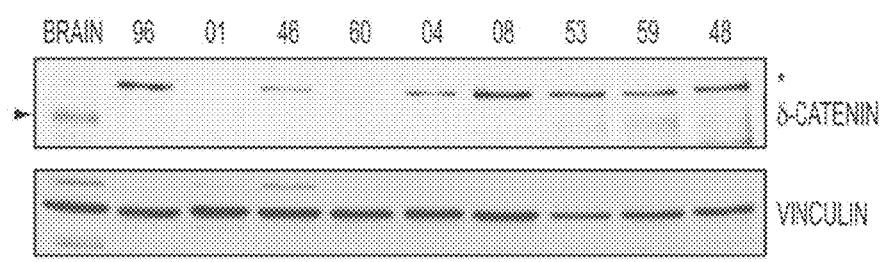

Immunostaining experiments showed that δ-catenin is strongly expressed in normal brain, particularly in neurons, as demonstrated by co-staining with the neuronal markers β3-tubulin and MAP2 but not the astrocytic marker GFAP (FIG. 18A-B). Conversely, immunostaining of 69 GBM and western blot of 9 glioma sphere cultures revealed negligible or absent expression of δ-catenin in 21 tumors and in most glioma sphere cultures (FIG. 22). Oncogenic transformation in the CNS frequently disrupts the default proneural cell fate and induces an aberrant mesenchymal phenotype associated with aggressive clinical outcome[42]. Gene expression analysis of 498 GBM from ATLAS-TCGA showed that low CTNND2 expression is strongly enriched in tumors exhibiting the mesenchymal gene expression signature (t-test p-value=2.4 $10^{-12}$, FIG. 10D). Tumors with reduced CTNND2 were characterized by poor clinical outcome and, among them, tumors with CTNND2 copy number loss displayed the worst prognosis (FIG. 3C-D). Patients with low CTNND2 expression showed the worst clinical outcome in mesenchymal GBM, though non-mesenchymal tumors also demonstrated poor prognosis, albeit with reduced strength (FIG. 3D).

Figure 18C:
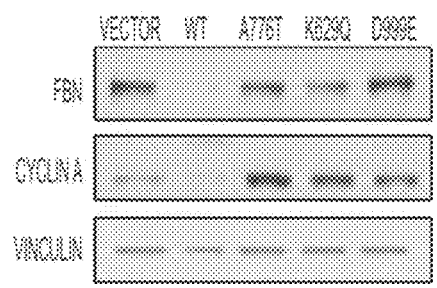
FIG. 18C is a photographic image of a western blot using the indicated antibodies for U87 cells expressing δ-catenin wild type, glioma-associated δ-catenin mutants or the empty vector. FBN, fibronectin. Vinculin is shown as control for loading.
Figure 23A:
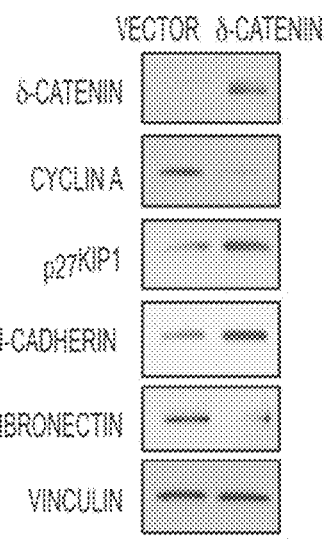
FIGS. 23A-B show the effects of expression of δ-catenin in glioma cells.
Figure 23B:
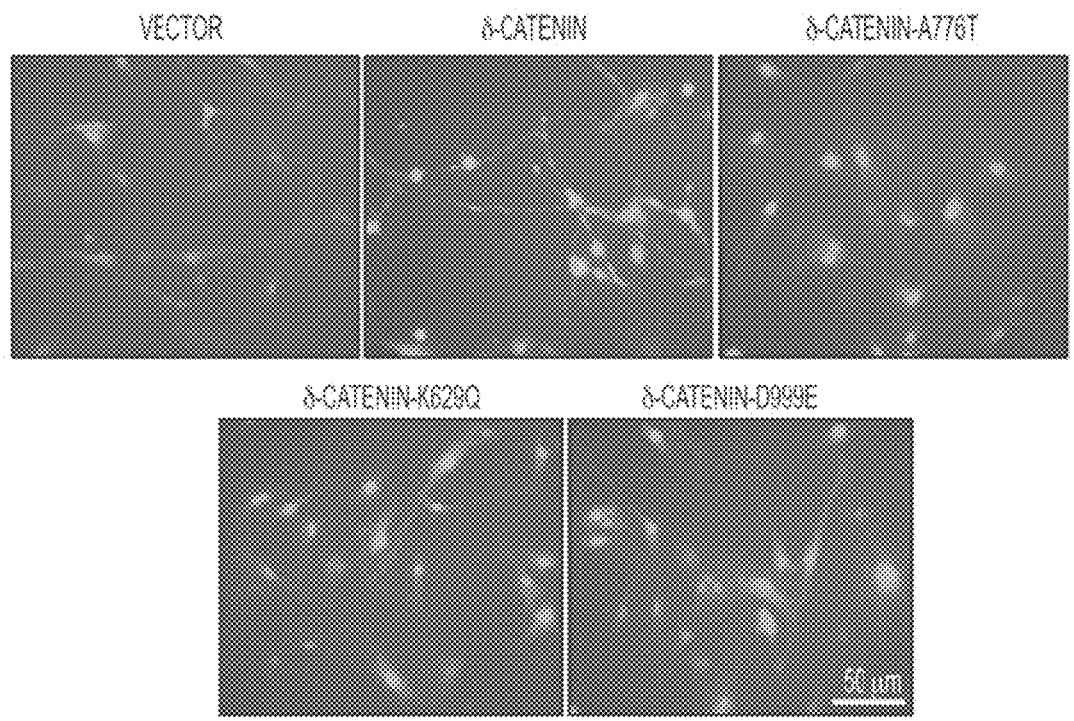
Figure 23C:
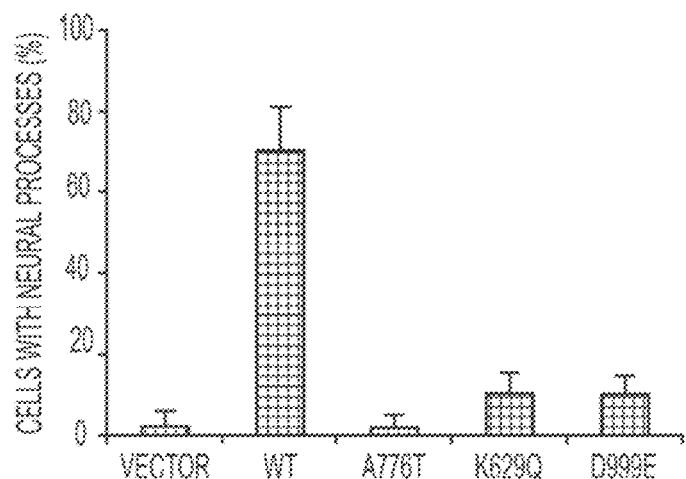
FIG. 23C is a bar graph that shows the effects of expression of δ-catenin in glioma cells. The number of cells displaying neural processes was scored. At least 200 cells/sample were analyzed.

Mesenchymal transformation of GBM is associated with irreversible loss of proneural cell fate and neuronal markers' and is detected in most established glioma cell lines. Expression of δcatenin in the U87 human glioma cell line reduced cell proliferation (FIG. 3E), elevated expression of neuronal proteins βIII-tubulin, PSD95 (a post-synaptic marker) and N-cadherin (FIG. 3G, FIG. 23A) and decreased mRNA and protein levels of mesenchymal markers (FIG. 3F, FIG. 18C, FIG. 23A). These effects were associated with morphologic changes characterized by neurite extension and development of branched dendritic processes (FIG. 3F, FIG. 23B-23C). Conversely, expression of the A776T, K629Q and D999E mutants of CTNND2 failed to induce neuronal features and down-regulate the mesenchymal marker fibronectin (FBN, FIG. 18C, FIG. 23B-23C). Consistent with δ-catenin inhibition of cell proliferation in glioma cells, only wild type δ-catenin decreased cyclin A, a S-phase cyclin (FIG. 18C).

Figure 19A:
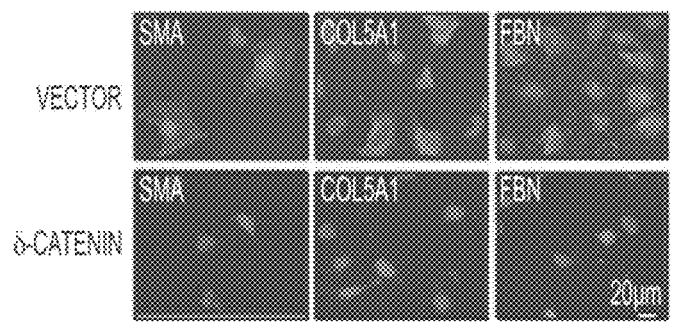
FIGS. 19A-B show a functional analysis of δ-catenin in mesenchymal GBM.
Figure 19B:
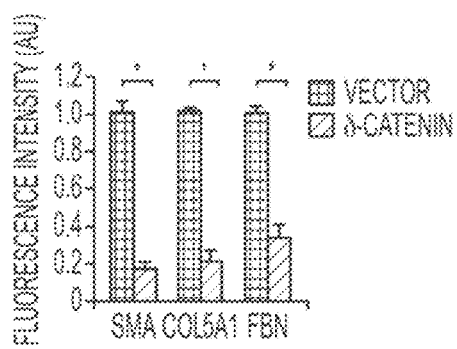
Figure 19C:
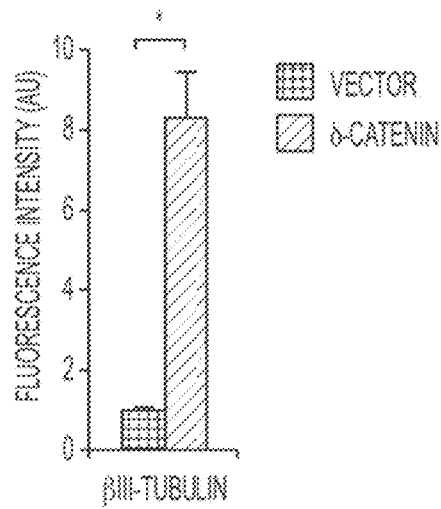
FIG. 19C is a bar graph showing the quantification of fluorescence intensity for βIII-tubulin in cells #48 infected with lentiviruses expressing CTNND2 or the empty vector.
Figure 21:
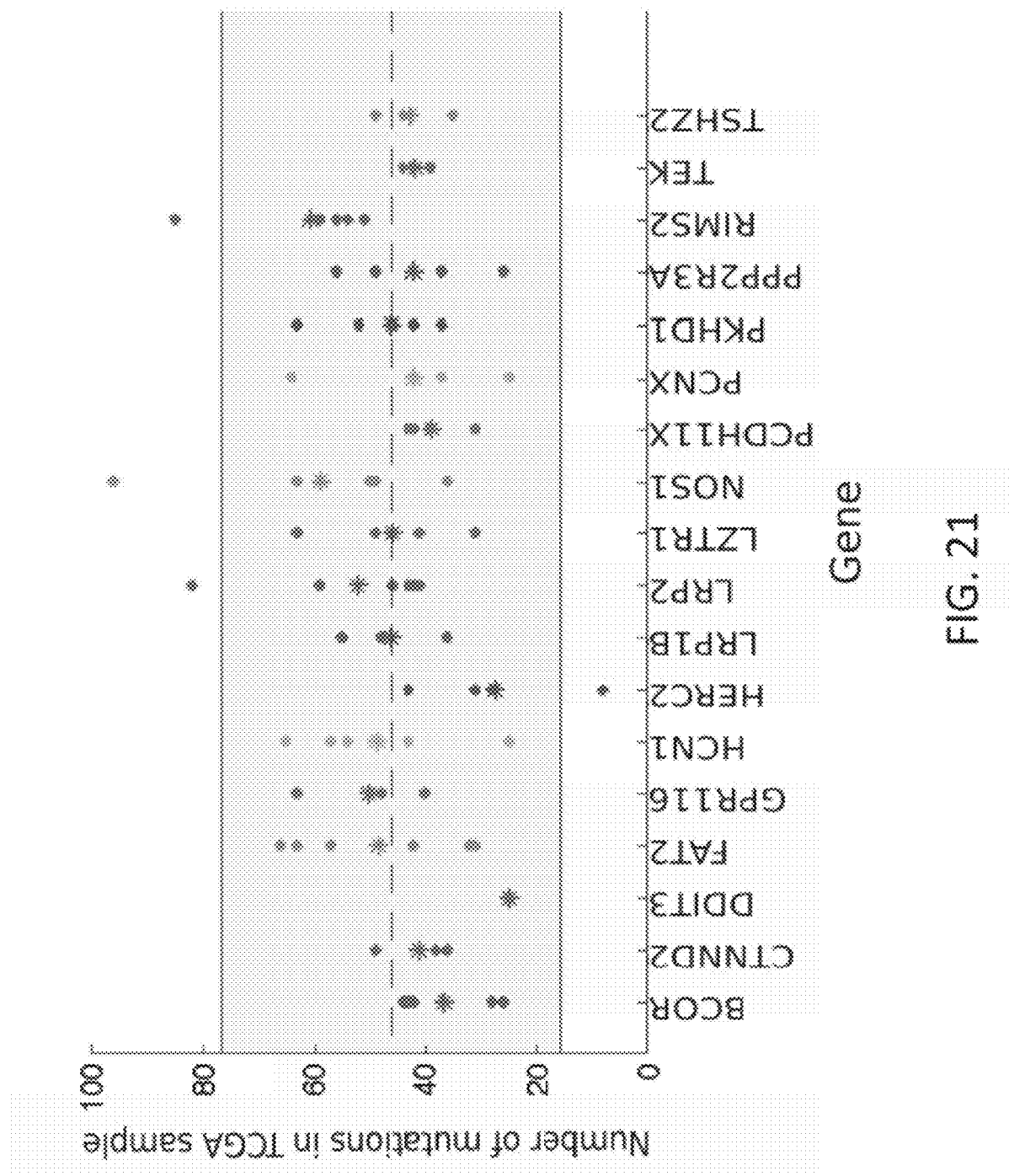
FIG. 21 is a plot showing the number of mutations in TCGA samples harboring MutComFocal gene candidates. For a given gene G, the number of mutations M8 was plotted in samples harboring G as solid circles. The mean of M8 is also plotted as asterisks. Given the mean, μ and standard deviation c of the number of mutations in all TCGA samples, the 95% confidence interval of a sample being hyper-mutated (11±1.96*a) was plotted and shown that for all G, the mean of M8 falls well within the 95% confidence interval, demonstrating that MutComFocal genes do not tend to occur in hypermutated samples.
Figure 23D:
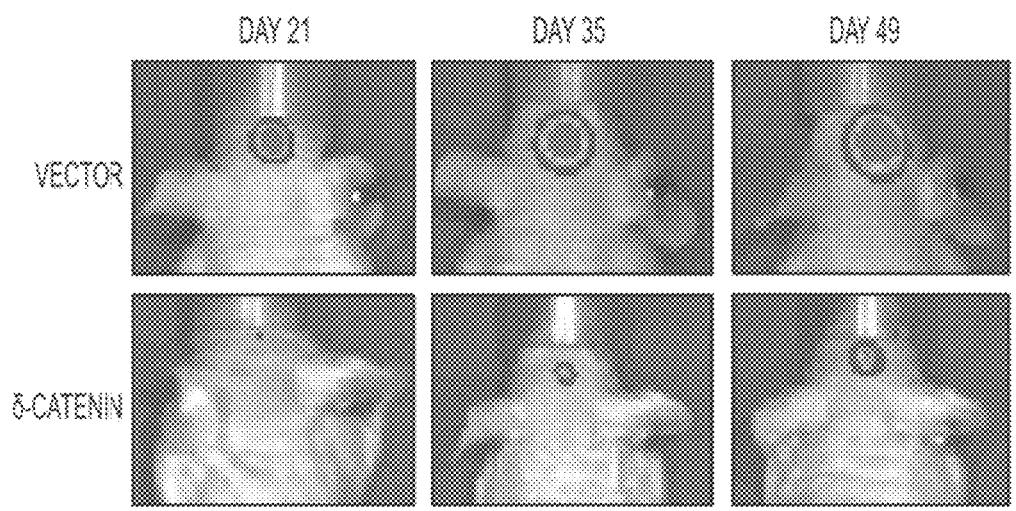
FIG. 23D are photographs of longitudinal bioluminescence imaging for one representative mouse injected intracranially with glioma sphere cells #48 transduced with lentivirus expressing CTNND2 (lower panels) or the empty vector (upper panels).

Next, the effect of expressing δ-catenin in GBM-derived sphere culture #48 that lacks the endogenous δ-catenin protein (FIG. 22B) and expresses high levels of mesenchymal markers was analyzed[43]. Introduction of δ-catenin in sphere culture #48 strongly reduced mesenchymal proteins smooth muscle actin (SMA), collagen-5A1 (Col5A1) and FBN, as measured by quantitative immunofluorescence (FIGS. 19A-B). It also induced βIII-tubulin more than eight-fold (FIGS. 19C-D). Time course analysis showed the highest degree of βIII-tubulin-positive neurite extension at 4-6 days post-transduction followed by progressive depletion of neuronal-like cells from culture (FIG. 19D). Finally, whether δ-catenin impacts self-renewal and growth of glioma spheres in vitro and their ability to grow as tumor masses in vivo were examined. In a limiting dilution assay, δ-catenin inhibited glioma sphere formation more than 8-fold (FIG. 19E). To determine the effect of δ-catenin on brain tumorigenesis in vivo, #48 glioma sphere cultures were generated expressing luciferase and bioluminescence imaging was conducted at different times after stereotactic transduction of control and δ-catenin-expressing cells in the mouse brain. When compared to controls, a 5-fold inhibition of tumor growth by δ-catenin at each time point analyzed (FIG. 19F, FIG. 23D). These results identify CTNND2 inactivation as a key genetic alteration driving the aggressive mesenchymal phenotype of GBM.

Recurrent EGFR Fusions in GBM

Figure 24:
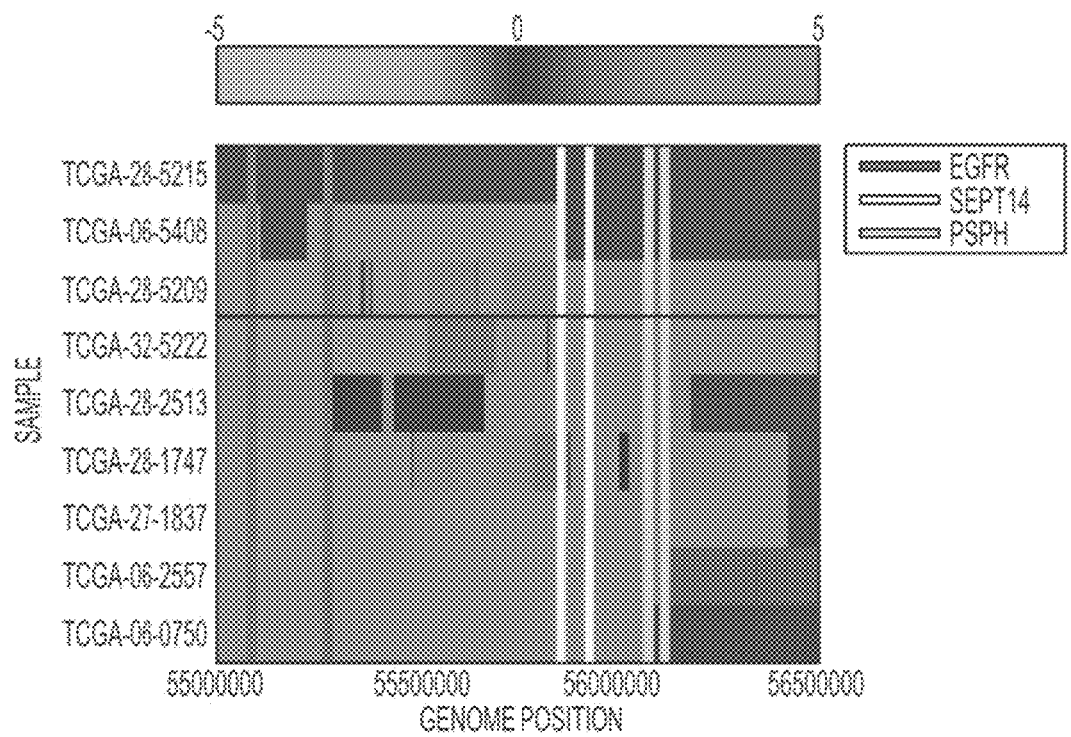
FIG. 24 is a heat map showing amplification surrounding the genomic neighborhood of EGFR, SEPT14, and PSPH among samples harboring EGFR fusions. Copy number was plotted log 2 ratio across the genomic region of chr7: 55000000-56500000 for samples with EGFR-PSPH (top three rows) and EGFR-SEPT14 (bottom six rows). Genomic coordinates are also plotted for EGFR (blue; dark grey in black and white image), SEPT14 (yellow; light grey in black and white image), and PSPH (cyan; grey in black and white image).

To identify gene fusions in GBM, RNA-seq data was analyzed from a total of 185 GBM samples (161 primary GBM plus 24 short-term glioma sphere cultures freshly isolated from patients carrying primary GBM). The analysis of RNA-seq led to the discovery of 92 candidate rearrangements giving rise to in-frame fusion transcripts (FIG. 27). Besides previously reported FGFR3-TACC3 fusions events, the most frequent recurrent in-frame fusions involved EGFR in 7.6% of samples (14/185, 3.8%-11.3% CI). Nine of 14 EGFR fusions included recurrent partners SEPT14 (6/185, 3.2%) and PSPH (3/185, 1.6%) as the 3' gene segment in the fusion. All EGFR-SEPT14 and two of three EGFR-PSPH gene fusions occurred within amplified regions of the fusion genes (FIG. 24).

The quantitative analysis of expressed reads spanning the fusion breakpoint versus reads spanning EGFR exons not implicated in the fusion transcripts revealed that EGFR fusion genes were expressed at higher levels in five of nine tumors (FIG. 30). Two in-frame highly expressed fusions involving the neurotrophic tyrosine kinase receptor 1 gene (NTRK1) as the 3' gene with two different 5' partners (NFASC-NTRK1 and BCAN-NTRK1). Fusions involving NTRK1 are common in papillary thyroid carcinomas[44]. Using EXomeFuse, an algorithm that reconstructs genomic fusions from whole-exome data, EGFR-SEPT14 and NRTK1 fusions result from recurrent chromosomal translocations and the corresponding genomic breakpoints were reconstructed (FIG. 31).

Figure 4B:
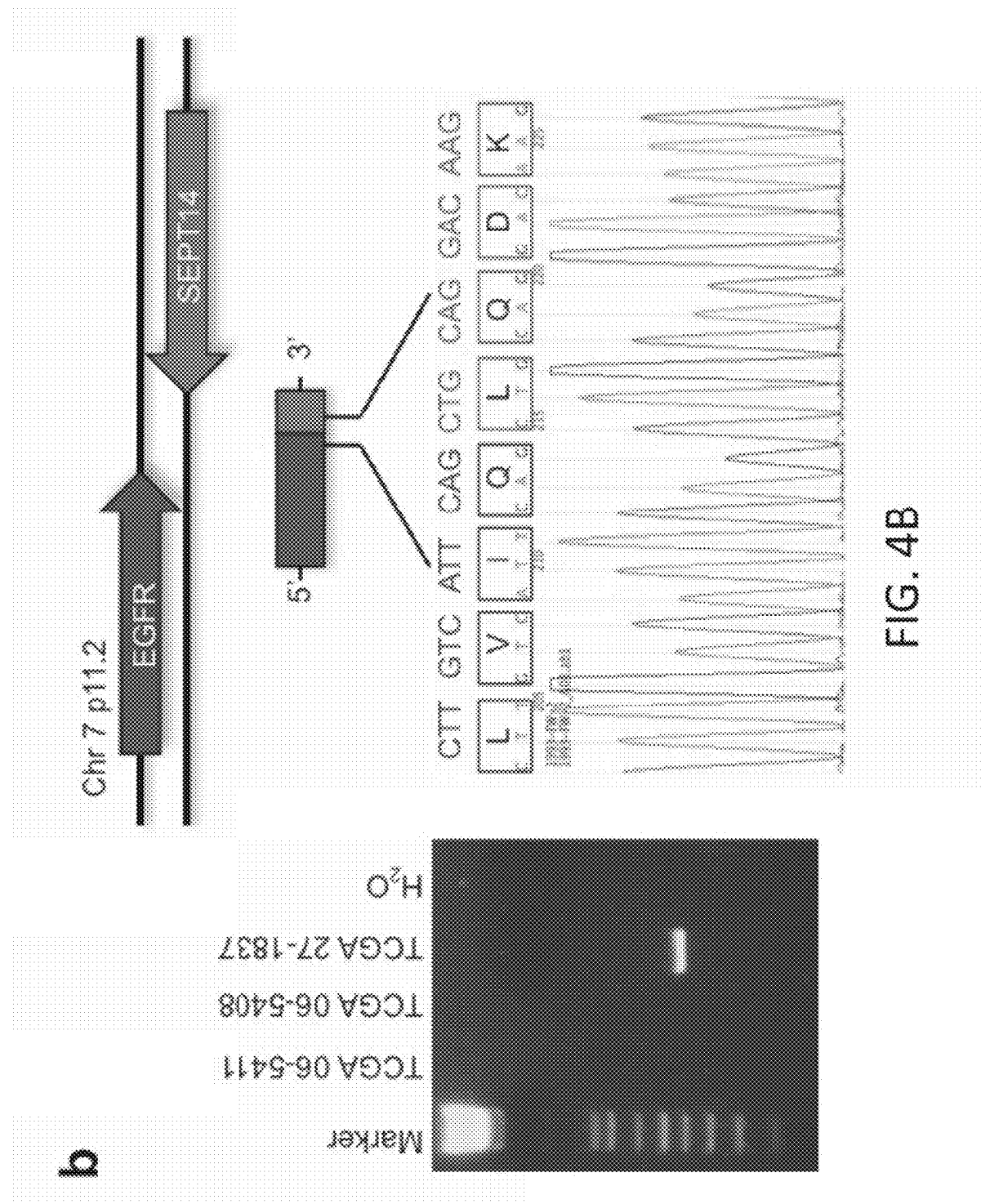
FIG. 4B. EGFR-SEPT14 gene fusion identified by whole transcriptome sequencing. (left panel), EGFR-SEPT14-specific PCR from cDNA derived from GBMs. Marker, 1 kb ladder. (right panel), Sanger sequencing chromatogram showing the reading frame at the breakpoint (SEQ ID NO: 4) and putative translation of the fusion protein (SEQ ID NO: 3) in the positive sample.
Figure 4D:
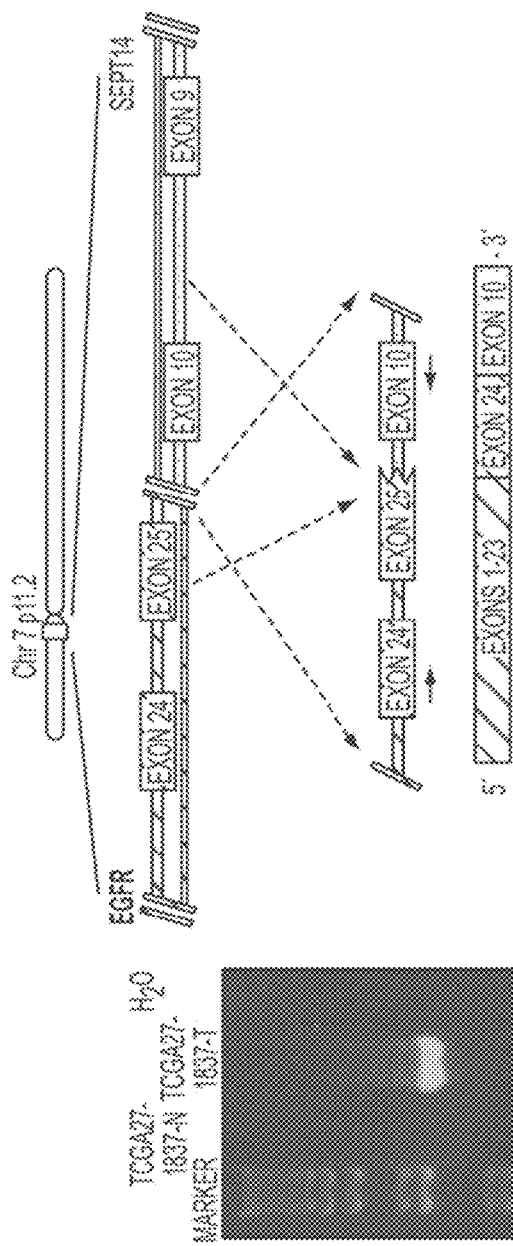
FIG. 4D. EGFR-SEPT14 gene fusion identified by whole transcriptome sequencing. Genomic fusion of EGFR exon 25 with intron 9 of SEPT14. In the fuse mRNA exon 24 of EGFR is spliced 5' to exon 10 of SEPT14. Solid arrows indicate the position of the fusion genome primers that generate a fusion specific PCR product in the GBM sample TCGA-27-1837.

The sequence of the PCR products spanning the fusion breakpoint validated all three types of recurrent in frame fusion predictions (EGFR-SEPT14, EGFR-PSPH and NRTK1 fusions, FIGS. 4, 11, 12). In FIGS. 4A-B, the prediction and cDNA sequence validation is shown respectively, for one tumor harboring an EGFR-SEPT14 fusion (TCGA-27-1837). The amplified cDNA contained an open reading frame for a 1,041 amino-acid protein resulting from the fusion of EGFR residues 1-982 with SEPT14 residues 373-432 (FIG. 4C). Thus, the structure of EGFR-Septin14 fusions involves EGFR at the N-terminus, providing a receptor tyrosine kinase domain fused to a coiled-coil domain from Septin14. Exon-specific RNA-seq expression in TCGA-27-1837 demonstrated that EGFR and SEPT14 exons implicated in the fusion are highly expressed compared with mRNA sequences not included in the fusion event (FIG. 13).

Using PCR, the genomic breakpoint was mapped to chromosome 7 (#55,268,937 for EGFR and #55,870,909 for SEPT14, genome build GRCh37/hg19) within EGFR exon 25 and SEPT14 intron 9, creating a transcript in which the 5' EGFR exon 24 is spliced to the 3' SEPT14 exon 10 (FIG. 4D). Interestingly, the fused EGFR-PSPH cDNA and predicted fusion protein in sample TCGA-06-5408 involves the same EGFR N-terminal region implicated in the EGFR-SEPT14 with PSPH providing a carboxy-terminal portion of 35 amino acids (FIG. 11). An example of a fusion in which the EGFR-TK region is the 3' partner is the CAND1-EGFR fusion in the glioma sphere culture #16 (FIG. 14). Each fusion transcript includes the region of the EGFR mRNA coding for the TK domain (FIG. 27). RT-PCR and genomic PCR followed by Sanger sequencing of GBM TCGA-06-5411 validated the NFASC-NTRK1 fusions in which the predicted fusion protein includes the TK domain of the high-affinity NGF receptor (TrkA) fused downstream to the immunoglobulin-like region of the cell adhesion and ankyrin-binding region of neurofascin (FIG. 12).

To confirm that GBM harbors recurrent EGFR fusions and determine the frequency in an independent dataset, cDNA was screened from a panel of 248 GBMs and discovered 10 additional cases with EGFR-SEPT14 fusions (4%). Conversely, NFASC-NTRK1 fusions were not detected in this dataset. A 2.2% (3/135) frequency of EGFR-PSPH fusions was determined.

The discovery of recurrent EGFR fusions in GBM is of particular interest. EGFR is activated in a significant fraction of primary GBM (~25%) by an in-frame deletion of exons 2-7 (EGFRvIII)[45]. However, seven of nine tumors harboring EGFR-SEPT14 and EGFR-PSPH gene fusions lacked the EGFRvIII rearrangement (FIG. 32). It was determined whether the most frequent EGFR fusion in GBM (EGFR-SEPT14) provides an alternative mechanism of EGFR activation and confers sensitivity to EGFR inhibition. First, whether EGFR gene fusions cluster into any gene expression subtype of GBM (proneural, neural, classical, mesenchymal) was investigated. Although no individual subtype displayed a statistically significant enrichment of EGFR fusions, 8 of 9 GBM harboring EGFR-SEPT14 or EGFR-PSPH belonged to the classical or mesenchymal subtype (Fisher's P value=0.05 for classical/mesenchymal enrichment, FIG. 33).

Figure 5C:
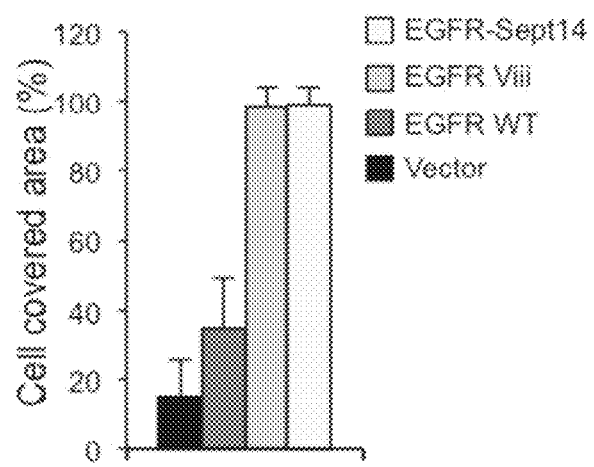
FIG. 5C. Expression of EGFR-SEPT14 fusion promotes an aggressive phenotype and inhibition of EGFR kinase delays GBM growth in vivo. Quantification of the cell covered area for the experiments shown in b (average of triplicate cultures). All error bars are SD.
Figure 25:
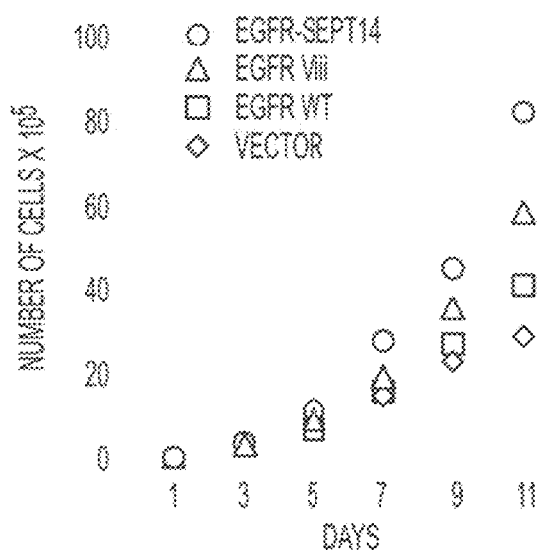
FIG. 25 is a plot showing the expression of EGFR-SEPT14 fusion promotes an aggressive phenotype and inhibition of EGFR kinase delays GBM growth in vivo. Growth rate of U87glioma cells transduced with a lentivirus expressing EGFR-SEPT14, EGFR Viii, EGFR WT or the empty vector (average of triplicate cultures).
Figure 26:
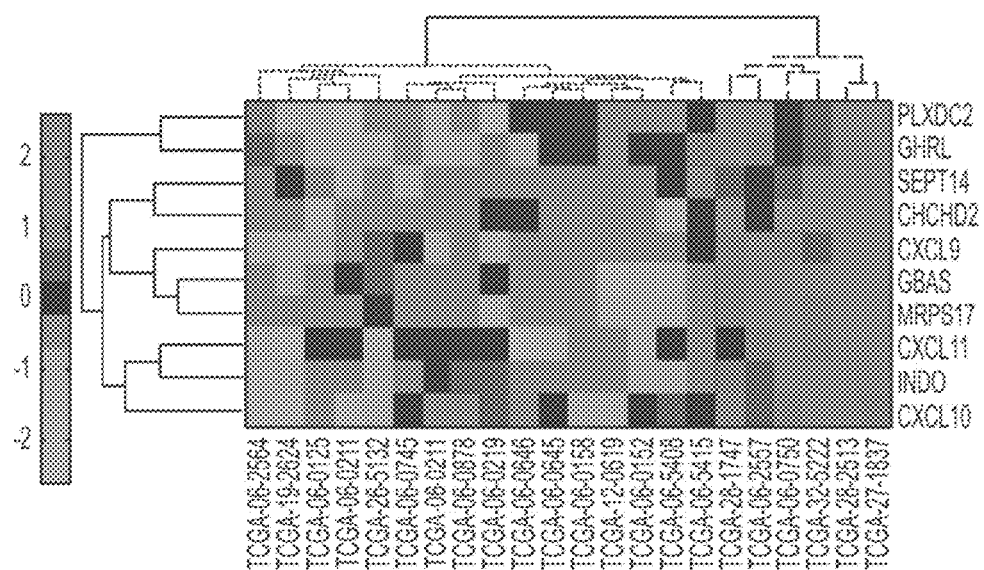
FIG. 26 is a map showing differential expression of GBM tumor samples harboring EGFR-SEPT14 fusions and EGFRvlll rearrangements. After filtering for statistical significance for differential expression, ten genes remained that characterized the EGFR-SEPT14 phenotype from the EGFRvlll phenotype. Log 2 expression was plotted as a heat map. Samples were hierarchically clustered by Euclidean distance using average linkage. This clustering demonstrates clear separation between EGFR-SEPT14 samples (red; dark grey in black and white image; corresponding to top half of intensity bar of left hand side) and EGFRvlll samples (green; light grey in black and white image; corresponding to bottom half of intensity bar of left hand side), confirming the unique molecular signature of the EGFR-SEPT14 gene fusion.

Next, the effects of ectopic EGFR-SEPT14, EGFRvIII or EGFR wild type on glioma cells were investigated. Lentiviral transduction of #48 human glioma sphere culture (which lacks genomic alteration of EGFR) showed that cells expressing EGFR-SEPT14 or EGFRvIII but not those expressing wild type EGFR or vector retained growth and self-renewal in the absence of EGF and bFGF (FIG. 20A). Accordingly, established glioma cell lines expressing EGFR-SEPT14 or EGFRvIII proliferated at higher rate than control cells or cells expressing wild type EGFR (FIG. 5A, FIG. 25). Furthermore, EGFR-SEPT14 and EGFRvIII markedly enhanced migration of glioma cells in a wound assay (FIG. 5B-C). The above findings indicate that EGFR-SEPT14 might constitutively activate signaling events downstream of EGFR. When analyzed in the presence and absence of mitogens, the expression of EGFR-SEPT14 (or EGFRvIII) in glioma sphere cultures #48 triggered constitutive activation of phospho-STAT3 but had no effects on phospho-ERK and phospho-AKT (FIG. 20B-C). This is consistent with enrichment of STAT3-target genes in primary human GBM harboring EGFR-SEPT14 fusions compared with tumors carrying wild type EGFR (FIG. 20D). Differential gene expression analysis identified a set of 9 genes up-regulated in EGFR-SEPT14 tumors compared with EGFRvIII-positive GBM (FIG. 26). These genes broadly relate to inflammatory/immune response, and some code for chemokines (CXCL9, 10, 11) that have been associated with aggressive glioma phenotypes[46].

Finally, it was investigated whether EGFR-SEPT14 fusions confer sensitivity to inhibition of EGFR-TK. Treatment of #48 expressing EGFR-SEPT14, EGFRvIII, wild type EGFR or vector control with lapatinib, an irreversible EGFR inhibitor recently proposed to target EGFR alterations in GBM[47], revealed that EGFR-Sept14 and EGFRvIII but not wild-type EGFR sensitized glioma cells to pharmaceutical EGFR inhibition (FIG. 20E). Similar effects were obtained following treatment of #48-derivatives with erlotinib, another inhibitor of EGFR-TK (FIG. 5D).

Figure 5E:
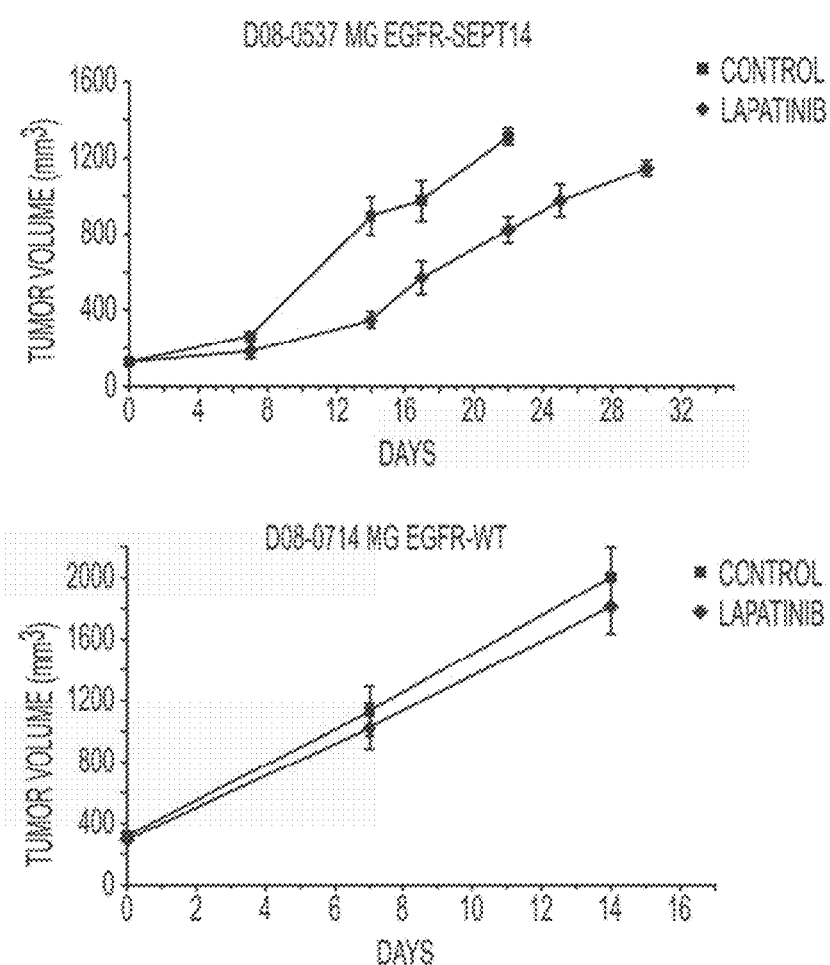
FIG. 5E. Expression of EGFR-SEPT14 fusion promotes an aggressive phenotype and inhibition of EGFR kinase delays GBM growth in vivo. Kinetics of tumor growth for the same xenografts treated with Lapatinib or vehicle (control). All error bars are SD.

To ask whether sensitivity to EGFR-TK inhibition is retained in human glioma cells naturally harboring EGFR-SEPT14 in vivo, an EGFR-SEPT14-positive GBM xenograft (D08-0537 MG) established from a heavily pretreated patient was used. Treatment of D08-0537 MG tumors with lapatinib or erlotinib showed that both drugs significantly delayed tumor growth, with lapatinib displaying the strongest anti-tumor effects. Conversely, EGFR inhibitors were ineffective against GBM xenograft D08-0714 MG, which lacks EGFR genomic alterations (FIG. 5E). Taken together, these data determine that EGFR-SEPT14 fusions confer mitogen-independent growth, constitutively activate STAT3 signaling and impart sensitivity to EGFR kinase inhibition to glioma cells harboring the fusion gene.

Discussion

A computational pipeline was described that computes frequency, magnitude and focality of CNVs at any loci in the human genome with the somatic mutation rate for genes residing at that genomic location, thus integrating into a single score two genetic hallmarks of driver cancer genes (focality of CNVs and point mutations). Besides recognizing nearly all genes known to have functional relevance in GBM, this study discovered and validated somatic mutations in 18 new genes, which also harbor focal and recurrent CNVs in a significant fraction of GBM. The importance of some of these genes extends beyond GBM, as underscored by cross-tumor relevance (e.g. BCOR), and protein family recurrence (e.g. LRP family members).

Also, the LZTR-1 mutations targeting highly conserved residues in the Kelch domain (W105, G248, T288) and in the second BTB-BACK domain (R810) are recurrent events in other tumor types[48]. Thus, understanding the nature of substrates of LZTR-1-Cul3 ubiquitin ligase activity will provide important insights into the pathogenesis of multiple cancer types. The importance of LZTR-1 genetic alterations in GBM is underscored by concurrent targeting of LZTR-1 by mutations and deletions that supports a two-hits mechanism of tumor suppressor gene inactivation as well as the impact of mutations targeting the BTB-BACK domains on Cul3 binding and/or protein stability, and their ability to release glioma cells from the restraining activity of the wild-type protein on self-renewal.

The finding that loss-of-function of CTNND2 cluster in mesenchymal GBM provides a clue to the genetic events driving this aggressive GBM subtype. The function of δ-catenin for crucial neuronal morphogenesis indicates that full-blown mesenchymal transformation in the brain requires loss of master regulators constraining cell determination along the neuronal lineage. Introduction of δ-catenin in human glioma spheres collapsed the mesenchymal phenotype and inhibited sphere formation and tumor growth. Thus, the ability of δ-catenin to reprogram glioma cells expressing mesenchymal genes towards a neuronal fate unravels an unexpected plasticity of mesenchymal GBM that might be exploited therapeutically.

In this study, the landscape of gene fusions from a large dataset of GBM analyzed by RNA-Sequencing is also reported. In-frame gene fusions retaining the RTK-coding domain of EGFR emerged as the most frequent gene fusion in GBM. In this tumor, EGFR is frequently targeted by focal amplications and our finding underscores the strong recombinogenic probability of focally amplified genes, as recently reported for the myc locus in medulloblastoma[49]. Resembling intragenic rearrangements that generate the EGFRvIII allele, EGFR-SEPT14 fusions impart to glioma cells the ability to self-renew and grow in the absence of mitogens, constitutively activate STAT3 signaling, and confer sensitivity to EGFR inhibition. These findings highlight the relevance of fusions implicating RTK-coding genes in the pathogenesis of GBM[9]. They also provide a strong rationale for the inclusion of GBM patients harboring EGFR fusions in clinical trials based on EGFR inhibitors.

Methods

SAVI (Statistical Algorithm for Variant Frequency Identification).

The frequencies of variant alleles were estimated in 139 paired tumor and normal whole-exome samples from TCGA using the SAVI pipeline[50]. The algorithm estimates the frequency of variant alleles by constructing an empirical Bayesian prior for those frequencies, using data from the whole sample, and obtains a posterior distribution and high credibility intervals for each allele[50]. The prior and posterior are distributed over a discrete set of frequencies with a precision of 1% and are connected by a modified binomial likelihood, which allows for some error rate. More precisely, a prior distribution p(f) of the frequency f and a prior for the error e uniform on the interval [0,E] for a fixed $0 \leq E \leq 1$ is assumed. The sequencing data at a particular allele is a random experiment producing a string of m (the total depth at the allele) bits with n '1's (the variant depth at the allele). Assuming a binomial likelihood of the data and allowing for bits being misread because of random errors, the posterior probability P(f) of the frequency f is $$P(f) = \frac{p(f)}{C} \cdot \frac{1}{b-a} \int_{f}^{f+E-2Ef} x^n (1-x)^{m-n} dx$$

where C is a normalization constant. For a particular allele, the value of E is determined by the quality of the nucleotides sequenced at that position as specified by their Phred scores. The SAVI pipeline takes as input the reads produced by the sequencing technology, filters out low-quality reads and maps the rest onto a human reference genome. After mapping, a Bayesian prior for the distribution of allele frequencies for each sample is constructed by an iterative posterior update procedure starting with a uniform prior. To genotype the sample, the posterior high-credibility intervals were used for the frequency of the alleles at each genomic location. Alternatively, combining the Bayesian priors from different samples, posterior high-credibility intervals were obtained for the difference between the samples of the frequencies of each allele. Finally, the statistically significant differences between the tumor and normal samples are reported as somatic variants. To estimate the positive prediction value of SAVI in the TCGA GBM samples, 41 mutations were selected for independent validation by Sanger sequencing. 39 of the 41 mutations using Sanger sequencing were confirmed, resulting in a 0.95 (95% CI 0.83-0.99) validation rate.

Candidate genes were ranked by the number of somatic nonsynonymous mutations. A robust fit of the ratio of nonsynonymous to synonymous mutations was generated with a bisquare weighting function. The excess of nonsynonymous alterations was estimated using a Poisson distribution with a mean equal to the product of the ratio from the robust fit and the number of synonymous mutations. Genes in highly polymorphic genomic regions were filtered out based on an independent cohort of normal samples. The list of these regions includes families of genes known to generate false positives in somatic predictions (for example, the HLA, KRT and OR gene families).

MutComFocal.

Key cancer genes are often amplified or deleted in chromosomal regions containing many other genes. Point mutations and gene fusions, conversely, provide more specific information about which genes may be implicated in the oncogenic process. MutComFocal was developed, a Bayesian approach that assigns a driver score to each gene by integrating point mutations and CNV data from 469 GBMs (Affymetrix SNP6.0). In general, MutComFocal uses three different strategies. First, the focality component of the score is inversely proportional to the size of the genomic lesion to which a gene belongs and thus prioritizes more focal genomic lesions. Second, the recurrence component of the MutComFocal score is inversely proportional to the total number of genes altered in a sample, which prioritizes samples with a smaller number of altered genes. Third, the mutation component of the score is inversely proportional to the total number of genes mutated in a sample, which achieves the twofold goal of prioritizing mutated genes on one hand and prioritizing samples with a smaller number of mutations on the other.

More specifically, for a particular sample, let $(c_1, N_1), \ldots, (c_k, N_k)$ describe the amplification lesions in that sample so that $N_i$ is the number of genes in the ith lesion and $c_i$ is its copy number change from normal. For a gene belonging to the ith lesion, the amplification recurrence sample score is defined as $(c_1, N_1), \ldots, (c_k, N_k)$, and its amplification focality sample score is defined as $(c_i / \Sigma_j c_j) \times (1/N_i)$. To obtain the amplification recurrence and focality scores for a particular gene, the corresponding sample scores were summed over all the samples and the result was normalized so that each score sums to 1. The deletion and recurrence scores are defined in a similar manner. The mutation score is analogous to a recurrence score in which it is assumed that mutated genes belong to lesions with only one gene.

The amplification/mutation score is defined as the product of the two amplification scores and the mutation score, whereas the deletion/mutation score is defined as the product of the two deletion scores and the mutation score. The amplification/mutation and deletion/mutation scores are normalized to 1, and for each score, genes are divided into tiers iteratively so that the top $2^X$ remaining genes are included in the next tier, where H is the entropy of the scores of the remaining genes normalized to 1. On the basis of their tier across the different types of scores, genes are assigned to being either deleted/mutated or amplified/mutated, and genes in the top tiers are grouped into contiguous regions. The top genes in each region are considered manually and selected for further functional validation.

The recurrence and focality scores can be interpreted as the posterior probabilities that a gene is driving the selection of the disease under two different priors, one global and one local in nature. The recurrence score is higher if a gene participates in many samples that do not have too many altered genes, whereas the focality score is higher if the gene participates in many focal lesions. Besides lending strong support to the inference of a gene as a potential driver, the directionality of the copy number alteration (amplification or deletion) informs the probable behavior of the candidate gene as an oncogene or tumor suppressor, respectively.

The genes displayed in FIG. 1 were selected on the basis of the MutComFocal ranking (top 250 genes), the size of the minimal region (less than 10 genes) and the frequency of mutations (more than 2% for deletion/mutations and at least 1% for amplification/mutations).

RNA-Seq Bioinformatics Analysis.

161 RNA-seq GBM tumor samples were analyzed from TCGA, a public repository containing large-scale genome sequencing of different cancers, plus 24 patient-derived GSCs. Nine GSC samples reported in previous studies were kept in our analysis to evaluate recurrence[9]. The samples were analyzed using the ChimeraScan[51] algorithm to detect a list of gene fusion candidates. Briefly, ChimeraScan detects those reads that discordantly align to different transcripts of the same reference (split inserts). These reads provide an initial set of putative fusion candidates. The algorithm then realigns the initially unmapped reads to the putative fusion candidates and detects those reads that align across the junction boundary (split reads). These reads provide the genomic coordinates of the breakpoint.

RNA-seq analysis detected a total of 39,329 putative gene fusion events. To focus the experimental analysis on biologically relevant fused transcripts, the Pegasus annotation pipeline (http://sourceforge.net/projects/pegasus-fus/) was applied. For each putative fusion, Pegasus reconstructs the entire fusion sequence on the basis of the genomic fusion breakpoint coordinates and gene annotations. Pegasus also annotates the reading frame of the resulting fusion sequences as either in frame or a frame shift. Moreover, Pegasus detects the protein domains that are either conserved or lost in the new chimeric event by predicting the amino acid sequence and automatically querying the UniProt web service. On the basis of the Pegasus annotation report, relevant gene fusions were selected for further experimental validation according to the reading frame and the conserved and lost domains. The selected list was based on in-frame events expressed by ten or more reads, with at least one read spanning the breaking point. To filter out candidate trans-splicing events, events with putative breakpoints at a distance of at least 25 kb were pursued.

Identification of Genetic Rearrangements Using Whole-Exome Data.

Although whole-exome sequencing data contain low intronic coverage that reduces the sensitivity for fusion discovery, they are readily available through the TCGA database. To characterize the genomic breakpoint of the chromosomal rearrangement, EXome-Fuse, a new gene fusion discovery pipeline that is designed particularly to analyze whole-exome data, was designed. For the samples harboring EGFR-SEPT14, EGFR-PSPH, NFASC-NTRK1 and BCAN-NTRK1 fusions in RNA, EXome-Fuse was applied to the corresponding whole-exome sequencing data deposited in TCGA. This algorithm can be divided into three stages: split-insert identification, split-read identification and virtual reference alignment. Mapping against the human genome reference hg18 with BWA, all split inserts are first identified to compile a preliminary list of fusion candidates. This list was pruned of any false positives produced from paralogous gene pairs using the Duplicated Genes Database and the EnsemblCompara GeneTrees[52]. Pseudogenes in the candidate list were annotated using the list from the HUGO Gene Nomenclature Committee (HGNC) database[53] and were given lower priority. Candidates were also filtered out between homologous genes, as well as those with homologous or low-complexity regions around the breakpoint. For the remaining fusion candidates, any supporting split reads were probed for and their mates using BLAST with a word size of 16, identity cutoff of 90% and an expectation cutoff of $10^{-4}$. A virtual reference was created for each fusion transcript and all reads were realigned to calculate a final tally of split inserts and split reads such that all aligning read pairs maintain forward-reverse directionality.

Targeted Exon Sequencing.

All protein-coding exons for the 24 genes of interest were sequenced using genomic DNA extracted from frozen tumors and matched blood. Five-hundred nanograms of DNA from each sample were sheared to an average size of 150 bp in a Covaris instrument for 360 s (duty cycle, 10%; intensity, 5; cycles per burst, 200). Bar-coded libraries were prepared using the Kapa High-Throughput Library Preparation Kit Standard (Kapa Biosystems). Libraries were amplified using the KAPA HiFi Library Amplification kit (Kapa Biosystems) (eight cycles). Libraries were quantified using Qubit Fluorimetric Quantitation (Invitrogen), and the quality and size was assessed using an Agilent Bioanalyzer. An equimolar pool of the four bar-coded libraries (300 ng each) was created, and 1,200 ng was input to exon capture using one reaction tube of the custom Nimblegen SeqCap EZ (Roche) with custom probes targeting the coding exons of the 38 genes. Capture by hybridization was performed according to the manufacturer's protocols with the following modifications: 1 nmol of a pool of blocker oligonucleotides (complementary to the bar-coded adapters) was used, and post-capture PCR amplification was done using the KAPA HiFi Library Amplification kit, instead of the Phusion High-Fidelity PCR Master Mix with HF Buffer Kit, in a 60 µl volume, as the Kapa HiFi kit greatly reduced or eliminated the bias against GC-rich regions.

The pooled capture library was quantified by Qubit (Invitrogen) and Bioanalyzer (Agilent) and sequenced in on an Illumina MiSeq sequencer using the 2×150 paired-end cycle protocol. Reads were aligned to the hg19 build of the human genome using BWA with duplicate removal using SAMtools as implemented by Illumina MiSeq Reporter. Variant detection was performed using GATK UnifiedGenotyper. Somatic mutations were identified for paired samples using SomaticSniper and filtered for frequency of less than 3% in normal samples and over 3% in tumor samples. Variants were annotated with the Charity annotator to identify protein-coding changes and cross referenced against known dbSNP, 1000 Genomes and COSMIC variants. Sanger sequencing was used to confirm each mutation from normal and tumor DNA.

Enrichment of Amplified and Deleted Genes for Single-Nucleotide Variants (SNVs).

Although MutComFocal combines SNV and CNV data to identify genes driving oncogenesis, it does not explicitly determine whether amplified or deleted genes are enriched for SNVs within the same sample. Deletions and SNVs of a gene within the same sample might indicate a two-hit model of a tumor suppressor. Alternatively, amplifications and gain-of-function mutations of an oncogene within the sample might further promote oncogenesis. For each MutComFocal candidate gene, the number of TCGA samples was determined with both amplification and SNVs, amplification alone, SNVs alone or neither. The corresponding Fisher's P value was calculated. A similar analysis for deletions was performed.

Correlation Between Copy Number and Expression.

One method of assessing the functional relevance of an amplified or deleted gene is to assess the effect of gene dosage. For each gene nominated by MutComFocal, the Pearson's correlation coefficient was calculated between copy number and expression. The corresponding P values were computed using paired Student's t test.

Allele-Specific Expression of SNVs.

For a given gene nominated by MutComFocal, RNA sequencing can determine whether the mutant or wild-type allele is expressed. Toward this end, VCFtools54 was applied to the TCGA BAM RNA-seq files produced by TopHat, which produces the depth of reads calling the reference (R) and variant (V) allele. A measure of relative expression of the variant allele is then V/(V+R). For each mutation, the binomial P value of observing more than V out of V+R reads was calculated, assuming that it is equally probable for a read to call the variant or reference. The binomial P values of each mutation were then pooled using the Stouffer's Z-score method to calculate the combined P value per gene.

Ruling Out Passenger Mutations in Hypermutated Samples.

To rule out the possibility that MutComFocal candidates tend to be passenger mutations in hypermutated samples, the number of mutations was compared in samples harboring a MutComFocal mutation to the distribution N of the number of mutations in each TCGA sample. Because the number of TCGA samples was well above 30, N was assumed to be well approximated by the normal distribution and calculated the mean, $\mu$, and s.d., $\sigma$. For each MutComFocal mutation, the Z-test was performed and all mutations failed statistical significance after correction by the Benjamini-Hochberg method.

Determining the Presence of EGFRvIII Transcripts.

To determine the prevalence of EGFRvIII transcripts, an in-house script was created to calculate the number of split inserts and split reads supporting the junction between EGFR exons 1 and 8. The EGFRvIII isoform was considered to be expressed if there were more than five split reads or five split inserts in a sample.

Calculating the Relative Expression of EGFR Fusions Compared to Wild-Type EGFR.

To determine the functional relevance of EGFR-SEPT14 and EGFR-PSPH fusions, the relative expression was determined between the fusion and wild-type transcripts within each sample on the basis of BAM files mapped by TopHat and provided by TCGA. As a proxy for expression of the transcript, the depth of reads covering either a mutant or wild-type junction was calculated. In particular, the depth of reads covering the fusion breakpoint of EGFR-SEPT14 or EGFR-PSPH was considered to estimate the expression of the fusion transcript. Because all EGFR fusions stereotypically involved exon 24 joined to either SEPT14 or PSPH, the depth of reads covering the junctions between EGFR exons 25-26, 26-27 and 27-28 to be a specific gauge of wild-type EGFR expression was assessed.

Enrichment of the Classical and Mesenchymal Subtype Among Samples with EGFR Fusions.

To assess whether samples with EGFR fusions tended to occur in a particular GBM subtype, each TCGA GBM sample was first classified by expression according to the methods of Verhaak et al.[6]. The number of classical, mesenchymal, proneural and neural samples was then tallied with and without EGFR gene fusions. The combined class of classical and mesenchymal phenotype was enriched for EGFR fusions according to the Fisher's exact test.

Copy Number Variation in EGFR Fusions.

Gene fusions often arise from genomic instability. Motivated by this observation, segmented SNP array data was downloaded from TCGA and calculated the log 2 ratio between the tumor and normal copy numbers. This was plotted along the chromosomal neighborhood of EGFR, SEPT14 and PSPH (chr7:55,000,000-56,500,000).

GSEA.

To determine the biological impact of LZTR1 mutations, GSEA[55] was used, which is an analytical tool that harnesses expression data to nominate gene sets enriched for a particular phenotype. Having identified TCGA samples with LZTR1 SNVs, GSEA was applied to the TCGA expression data. Samples were first compared with LZTR1 SNVs against those with wild-type LZTR1 (excluding LZTR1 deletions). To assess statistical significance, the data set was randomized by permuting gene sets 500 times and considered only gene sets with an FDR q<0.05.

Differential Expression Between Samples with EGFR-SEPT14 and EGFRvIII.

In-house differential expression analysis was also performed to determine a distinct molecular signature distinguishing the EGFR-SEPT14 and EGFRvIII phenotypes. Toward this end, a t test was performed comparing the expression of the two groups of samples for each gene. Correcting using the Benjamini-Hochberg method, only genes with FDR<0.05 were considered. In addition, genes were excluded with a variance less than the tenth percentile or absolute value lower than two across all samples. These filters left a predictive set of ten genes. Hierarchical clustering was then performed on the expression of these ten genes using Euclidean distance and average linkage.

Modeling of LZTR1.

Structural templates for the kelch and BTB-BACK regions of human LZTR1 were identified with HHpred[56]. An initial three-dimensional model was generated with the I-TASSER server[57]. The CUL3 N-terminal domain was docked onto the model by superposing the KLHL3$^{BTB-BACK}$/CUL3$^{NTD}$ crystal structure[27] onto the second LZTR1 BTB-BACK domain. The model does not include higher quaternary structure, although many BTB domains, and many kelch domains, are known to self associate[25]. The short linkage between the end of the first BACK domain and the beginning of the second BTB domain would seem to preclude an intrachain BTB-BTB pseudo-homodimer, and without being bond by theory, LZTR1 should self associate and form higher-order assemblies. Both BACK domains are the shorter, atypical form of the domain and consist of two helical hairpin motifs, as in SPOP[26,58], and not the four-hairpin motif seen in most BTB-BACK-kelch proteins[28,58]. The model from the kelch domain predicts an unusual 1+3 velcro arrangement[59], with the N-terminal region contributing strand d of blade 1 and the C-terminal region contributing strands a, b and c of the same blade, although an alternative 2+2 velcro model cannot be ruled out.

Cell Culture.

U87 cells were obtained from ATCC. SNB19, U87 and HEK-293T cells were cultured in DMEM supplemented with 10% fetal bovine serum (FBS). Growth rates were determined by plating cells in six-well plates at 3 d after infection with the lentivirus indicated in the figure legends. The number of viable cells was determined by Trypan blue exclusion in triplicate cultures obtained from triplicate independent infections. For the wound assay testing migration, confluent cells were scratched with a pipette tip and cultured in 0.25% FBS. After 16 h, images were taken using the Olympus IX70 connected to a digital camera. Images were processed using the ImageJ64 software. The area of the cell-free wound was assessed in triplicate samples. Experiments were repeated twice.

GBM-derived primary cultures were grown in DMEM: F12 medium containing N2 and B27 supplements and human recombinant FGF-2 and EGF (50 ng/ml each; Peprotech). For sphere formation, cells were infected with lentiviral particles. Four days later, single cells were plated at density of 1 cells per well in triplicate in low-attachment 96-well plates. The number and the size of spheres were scored after 10-14 d. Limiting dilution assays were performed as described previously[60]. Spheres were dissociated into single cells and plated in low-attachment 96-well plates in 0.2 ml of medium containing growth factors (EGF and FGF-2), except for the EGFR-transduced cells, which were cultured in the absence of EGF. Cultures were left undisturbed for 10 d, and then the percentage of wells not containing spheres for each cell dilution was calculated and plotted against the number of cells per well. Linear regression lines were plotted, and the number of cells required to generate at least one sphere in every well (the stem cell frequency) was calculated. The experiment was repeated twice. Treatment of GBM primary cultures with erlotinib or lapatinib was performed in cells transduced with the pLOC vector, wild-type pLOC-EGFR, EGFRvIII or EGFR-SEPT14 and selected with blasticidin for 5 d. Cells were seeded on 6-cm dishes in the absence of EGF and treated with the indicated drugs at the indicated doses for 48 h. Each treatment group was seeded in triplicate. Absolute viable cell counts were determined by Trypan blue exclusion and counted on a hemocytometer. EGF stimulation of EGFR-transduced primary glioma cells was performed in cells deprived of growth factors for 48 h. Cells were collected at the indicated times and processed for protein blot analysis.

Immunofluorescence.

Immunofluorescence staining on normal mouse and human brain and brain tumor tissue microarrays were performed as previously described[43, 61, 62]. Immunofluorescence microscopy was performed on cells fixed with 4% paraformaldehyde in phosphate buffer. Cells were permeabilized using 0.2% Triton X-100. The antibodies and concentrations used in the immunofluorescence staining are detailed in FIG. 34.

Secondary antibodies conjugated to Alexa Fluor 594 (1:300, A11037, Molecular Probes) or Alexa 488 (1:500, A11008, Molecular Probes) were used. DNA was stained with DAPI (Sigma). Fluorescence microscopy was performed on a Nikon AIR MP microscope. Quantification of the fluorescence intensity staining in primary or established glioma cells was performed using NIH ImageJ software (see URLs). A histogram of the intensity of fluorescence of each point of a representative field for each condition was generated. The fluorescence intensity of ten fields from three independent experiments was scored, standardized to the number of cells in the field and divided by the intensity of the vector.

Protein Blotting, Immunoprecipitation and In Vitro Binding.

Protein blot analysis and immunoprecipitation were performed using the antibodies detailed in FIG. 35. For the in vitro binding between CUL3 and LZTR1, wild-type and mutant LZTR1 were translated in vitro using the TNT Quick Coupled Transcription/Translation System (Promega). Flag-CUL3 was immunoprecipitated from transfected HEK-293T cells with Flag-M2 beads (Sigma) using RIPA buffer (50 mM Tris-HCl, pH 7.5, 150 mM NaCl, 1% NP-40, 0.5% sodium deoxycholate (DOC), 0.1% SDS, 1 mM phenylmethylsulfonyl fluoride (PMSF), 10 mM NaF, 0.5 M $Na_3OV_4$ (sodium orthovanadate) and Complete Protease Inhibitor Cocktail, Roche). Binding was performed in 200 mM NaCl plus 0.5% NP-40 for 2 h at 4° C. Immunocomplexes were analyzed by SDS-PAGE and immunoblot.

Cloning and Lentiviral Production.

The lentiviral expression vectors pLOC-GFP and pLOC-CTNND2 were purchased from Open Biosystems. Full-length EGFR-SEPT14 cDNA was amplified from tumor sample TCGA-27-1837. Wild-type EGFR, EGFRvIII and EGFR-SEPT14 cDNAs were cloned into the pLOC vector. pCDNA-MYC-Hist-LZTR1 was a kind gift[24]. pCDNA-Flag-CUL3 was a gift. Wild-type and mutant cDNAs for LZTR1 and CTNND2 obtained by site-directed mutagenesis (QuikChange II, Agilent) were cloned into the pLOC vector. Lentiviral particles were produced using published protocols[43, 61, 62, 63, 64].

Genomic PCR and RT-PCR.

Total RNA was extracted from cells using an RNeasy Mini Kit (QIAGEN) following the manufacturer's instructions. Five-hundred nanograms of total RNA was retrotranscribed using the Superscript III kit (Invitrogen) following the manufacturer's instructions. The cDNAs obtained after the retrotranscription were used as templates for quantitative PCR as described[43, 64]. The reaction was performed with a Roche480 thermal cycler using the Absolute Blue QPCR SYBR Green Mix from Thermo Scientific. The relative amount of specific mRNA was normalized to GAPDH. Results are presented as the mean±s.d. of triplicate amplifications. The validation of fusion transcripts was performed using both genomic PCR and RT-PCR with forward and reverse primer combinations designed within the margins of the paired-end read sequences detected by RNA-seq. Expressed fusion transcript variants were subjected to direct sequencing to confirm the sequence and translation frame. The primers used for the screening of gene fusions are detailed in FIG. 36. The primers used for genomic detection of gene fusions are listed in FIG. 37. Semiquantitative RT-PCR to detect exogenous wild-type MYC-LZTR1 and mutant p.Arg801Trp LZTR1 was performed using the primers listed in FIG. 38.

Subcutaneous Xenografts and Drug Treatment.

Female athymic mice (nu/nu genotype, BALB/c background, 6-8 weeks old) were used for all antitumor studies. Patient-derived adult human glioblastoma xenografts were maintained. Xenografts were excised from host mice under sterile conditions and homogenized with the use of a tissue press and modified tissue cytosieve (Biowhitter Inc.), and tumor homogenate was loaded into a repeating Hamilton syringe (Hamilton, Co.) dispenser. Cells were injected subcutaneously into the right flank of the athymic mouse at an inoculation volume of 50 ml with a 19-gauge needle[65].

Subcutaneous tumors were measured twice weekly with hand-held vernier calipers (Scientific Products). Tumor volumes (V) were calculated with the following formula: $((width)^2 \times (length))/2 = V (mm^3)$. For the subcutaneous tumor studies, groups of mice randomly selected by tumor volume were treated with EGFR kinase inhibitors when the median tumor volumes were an average of 150 mm³ and were compared with control animals receiving vehicle (saline).

Erlotinib was administered at 100 mg per kg body weight orally once per day for 10 d. Lapatinib was administered at 75 mg per kg body weight orally twice per day for 20 d. Response to treatment was assessed by a delay in tumor growth and tumor regression.

Growth delay, expressed as a T-C value, is defined as the difference in days between the median time required for tumors in treated and control animals to reach a volume five times greater than that measured at the start of the treatment. Tumor regression is defined as a decrease in tumor volume over two successive measurements. Statistical analysis was performed using a SAS statistical analysis program, the Wilcoxon rank-order test for growth delay and Fisher's exact test for tumor regression.

Intracranial Injection.

GBM-derived primary cells were first infected with a lentivirus expressing luciferase and subsequently transduced with the pLOC vector or pLOC-CTNND2 lentiviral particles. Intracranial injection was performed in 9-week-old male nu/nu mice (Charles River Laboratories). Briefly, $5 \leq 10^5$ cells were resuspended in 2.5 µl of PBS and injected into the caudate putamen using a stereotaxic frame (coordinates relative to the bregma: 0.6 mm anterior; 1.65 mm medium-lateral; 3 mm depth-ventral). Tumor growth was monitored using the IVIS Imaging system. Briefly, mice were anesthetized with 3% isoflurane before intraperitoneal injection of 100 mg per kg body weight n-luciferin (Xenogen). Ten minutes after injection of n-luciferin, images were acquired for 1 min with the Xenogen IVIS system (Xenogen) using Living Image acquisition and analysis software (Xenogen). The bioluminescent signal was expressed in photons per second and displayed as a pseudo-color image representing the spatial distribution of photon counts.

URLs.

DNA and RNA sequencing and copy number variant data in The Cancer Genome Atlas (TCGA), http://cancergenome.nih.gov; glioma patient survival data from the Repository for Molecular Brain Neoplasia Data (REMBRANDT), https://caintegrator.nci.nih.gov/rembrandt/; sequence data deposition in database of Genotypes and Phenotypes (dbGaP), http://www.ncbi.nlm.nih.gov/gap; gene fusion annotation software package Pegasus, http://sourceforge.net/projects/pegasus-fus/.

Data Access.

RNA sequencing of twenty-four human GBM sphere cultures in this study were deposited under the dbGaP study accession phs000505.v2.p1. RNA and DNA sequencing of TCGA GBM samples was also analyzed from the dbGaP study accession phs000178.vl.p1.

REFERENCES FOR EXAMPLE 2

1 Porter, K. R., McCarthy, B. J., Freels, S., Kim, Y. & Davis, F. G. Prevalence estimates for primary brain tumors in the United States by age, gender, behavior, and histology. *Neuro-oncology* 12, 520-527, doi:10.1093/neuonc/nop066 (2010).

2 Stupp, R. et al. Radiotherapy plus concomitant and adjuvant temozolomide for glioblastoma. *The New England journal of medicine* 352, 987-996, doi:10.1056/NEJMoa043330 (2005).

3 Cancer Genome Atlas Research, N. Comprehensive genomic characterization defines human glioblastoma genes and core pathways. *Nature* 455, 1061-1068, doi:10.1038/nature07385 (2008).

4 Noushmehr, H. et al. Identification of a CpG island methylator phenotype that defines a distinct subgroup of glioma. *Cancer Cell* 17, 510-522, doi:10.1016/j.ccr.2010.03.017 (2010).

5 Parsons, D. W. et al. An integrated genomic analysis of human glioblastoma multiforme. *Science* 321, 1807-1812, doi:10.1126/science.1164382 (2008).

6 Verhaak, R. G. et al. Integrated genomic analysis identifies clinically relevant subtypes of glioblastoma characterized by abnormalities in PDGFRA, IDH1, EGFR, and NF1. *Cancer Cell* 17, 98-110, doi:10.1016/j.ccr.2009.12.020 (2010).

7 Bass, A. J. et al. Genomic sequencing of colorectal adenocarcinomas identifies a recurrent VTI1A-TCF7L2 fusion. *Nat Genet* 43, 964-968, doi:10.1038/ng.936 (2011).

8 Chinnaiyan, A. M. & Palanisamy, N. Chromosomal aberrations in solid tumors. *Prog Mol Biol Transl Sci* 95, 55-94, doi:10.1016/B978-0-12-385071-3.00004-6 (2010).

9 Singh, D. et al. Transforming fusions of FGFR and TACC genes in human glioblastoma. *Science* 337, 1231-1235, doi:10.1126/science.1220834 (2012).

10 Rubin, A. F. & Green, P. Mutation patterns in cancer genomes. *Proc Natl Acad Sci USA* 106, 21766-21770, doi:10.1073/pnas.0912499106 (2009).

11 Fan, Z. et al. BCOR regulates mesenchymal stem cell function by epigenetic mechanisms. *Nat Cell Biol* 11, 1002-1009, doi:10.1038/ncb1913 (2009).

12 Wamstad, J. A. & Bardwell, V. J. Characterization of Bcor expression in mouse development. *Gene Expr Patterns* 7, 550-557, doi:10.1016/j.modgep.2007.01.006 (2007).

13 Wamstad, J. A., Corcoran, C. M., Keating, A. M. & Bardwell, V. J. Role of the transcriptional corepressor Bcor in embryonic stem cell differentiation and early embryonic development. *PLoS One* 3, e2814, doi:10.1371/journal.pone.0002814 (2008).

14 Pugh, T. J. et al. Medulloblastoma exome sequencing uncovers subtype-specific somatic mutations. *Nature* 488, 106-110, doi:10.1038/nature11329 (2012).

15 Zhang, J. et al. A novel retinoblastoma therapy from genomic and epigenetic analyses. *Nature* 481, 329-334, doi:10.1038/nature10733 (2012).

16 Beroukhim, R. et al. The landscape of somatic copy-number alteration across human cancers. *Nature* 463, 899-905, doi:10.1038/nature08822 (2010).

17 Kantarci, S. et al. Mutations in LRP2, which encodes the multiligand receptor megalin, cause Donnai-Barrow and facio-oculo-acoustico-renal syndromes. *Nat Genet* 39, 957-959, doi:10.1038/ng2063 (2007).

18 Willnow, T. E. et al. Defective forebrain development in mice lacking gp330/megalin. *Proc Natl Acad Sci USA* 93, 8460-8464 (1996).

19 Christ, A. et al. LRP2 is an auxiliary SHH receptor required to condition the forebrain ventral midline for inductive signals. *Dev Cell* 22, 268-278, doi:10.1016/j.devcel.2011.11.023 (2012).

20 Cowin, P. A. et al. LRP1B deletion in high-grade serous ovarian cancers is associated with acquired chemotherapy resistance to liposomal doxorubicin. *Cancer Res* 72, 4060-4073, doi:10.1158/0008-5472.CAN-12-0203 (2012).

21 Lima, F. R. et al. Glioblastoma: therapeutic challenges, what lies ahead. *Biochim Biophys Acta* 1826, 338-349, doi:10.1016/j.bbcan.2012.05.004 (2012).

22 Bekker-Jensen, S. et al. HERC2 coordinates ubiquitin-dependent assembly of DNA repair factors on damaged chromosomes. *Nat Cell Biol* 12, 80-86; sup pp 81-12, doi:10.1038/ncb2008 (2010).

23 Harlalka, G. V. et al. Mutation of HERC2 causes developmental delay with Angelman-like features. *J Med Genet* 50, 65-73, doi:10.1136/jmedgenet-2012-101367 (2013).

24 Nacak, T. G., Leptien, K., Fellner, D., Augustin, H. G. & Kroll, J. The BTB-kelch protein LZTR-1 is a novel Golgi protein that is degraded upon induction of apoptosis. *J Biol Chem* 281, 5065-5071, doi:10.1074/jbc.M509073200 (2006).

25 Stogios, P. J., Downs, G. S., Jauhal, J. J., Nandra, S. K. & Prive, G. G. Sequence and structural analysis of BTB domain proteins. *Genome Biol* 6, R82, doi:10.1186/gb-2005-6-10-r82 (2005).

26 Errington, W. J. et al. Adaptor protein self-assembly drives the control of a cullin-RING ubiquitin ligase. *Structure* 20, 1141-1153, doi:10.1016/j.str.2012.04.009 (2012).

27 Ji, A. X. & Prive, G. G. Crystal structure of KLHL3 in complex with Cullin3. *PLoS One* 8, e60445, doi:10.1371/journal.pone.0060445 (2013).

28 Canning, P. et al. Structural basis for Cul3 assembly with the BTB-Kelch family of E3 ubiquitin ligases. *J Biol Chem*, doi:10.1074/jbc.M112.437996 (2013).

29 Lo, S. C., Li, X., Henzl, M. T., Beamer, L. J. & Hannink, M. Structure of the Keap1:Nrf2 interface provides mechanistic insight into Nrf2 signaling. *EMBO J* 25, 3605-3617, doi:10.1038/sj.emboj.7601243 (2006).

30 Boyden, L. M. et al. Mutations in kelch-like 3 and cullin 3 cause hypertension and electrolyte abnormalities. *Nature* 482, 98-102, doi:10.1038/nature10814 (2012).

31 Louis-Dit-Picard, H. et al. KLHL3 mutations cause familial hyperkalemic hypertension by impairing ion transport in the distal nephron. *Nat Genet* 44, 456-460, S451-453, doi:10.1038/ng.2218 (2012).

32 Emanuele, M. J. et al. Global identification of modular cullin-RING ligase substrates. *Cell* 147, 459-474, doi:10.1016/j.cell.2011.09.019 (2011).

33 Galan, J. M. & Peter, M. Ubiquitin-dependent degradation of multiple F-box proteins by an autocatalytic mechanism. *Proc Natl Acad Sci USA* 96, 9124-9129 (1999).

34 Zhang, D. D. et al. Ubiquitination of Keap1, a BTB-Kelch substrate adaptor protein for Cul3, targets Keap1 for degradation by a proteasome-independent pathway. *J Biol Chem* 280, 30091-30099, doi:10.1074/jbc.M501279200 (2005).

35 Gunther, H. S. et al. Glioblastoma-derived stem cell-enriched cultures form distinct subgroups according to molecular and phenotypic criteria. *Oncogene* 27, 2897-2909, doi:10.1038/sj.onc.1210949 (2008).

36 Abu-Elneel, K. et al. A delta-catenin signaling pathway leading to dendritic protrusions. *J Biol Chem* 283, 32781-32791, doi:10.1074/jbc.M804688200 (2008).

37 Arikkath, J. et al. Delta-catenin regulates spine and synapse morphogenesis and function in hippocampal neurons during development. *J Neurosci* 29, 5435-5442, doi:10.1523/JNEUROSCI.0835-09.2009 (2009).

38 Kosik, K. S., Donahue, C. P., Israely, I., Liu, X. & Ochiishi, T. Delta-catenin at the synaptic-adherens junction. *Trends Cell Biol* 15, 172-178, doi:10.1016/j.tcb.2005.01.004 (2005).

39 Israely, I. et al. Deletion of the neuron-specific protein delta-catenin leads to severe cognitive and synaptic dysfunction. *Curr Biol* 14, 1657-1663, doi:10.1016/j.cub.2004.08.065 (2004).

40 Jun, G. et al. delta-Catenin is genetically and biologically associated with cortical cataract and future Alzheimer-related structural and functional brain changes. *PLoS One* 7, e43728, doi:10.1371/journal.pone.0043728 (2012).

41 Hicks, S., Wheeler, D. A., Plon, S. E. & Kimmel, M. Prediction of missense mutation functionality depends on both the algorithm and sequence alignment employed. *Hum Mutat* 32, 661-668, doi:10.1002/humu.21490 (2011).

42 Phillips, H. S. et al. Molecular subclasses of high-grade glioma predict prognosis, delineate a pattern of disease progression, and resemble stages in neurogenesis. *Cancer Cell* 9, 157-173, doi:10.1016/j.ccr.2006.02.019 (2006).

43 Carro, M. S. et al. The transcriptional network for mesenchymal transformation of brain tumours. *Nature* 463, 318-325, doi:10.1038/nature08712 (2010).

44 Pierotti, M. A. & Greco, A. Oncogenic rearrangements of the NTRK1/NGF receptor. *Cancer Lett* 232, 90-98, doi:10.1016/j.canlet.2005.07.043 (2006).

45 Dunn, G. P. et al. Emerging insights into the molecular and cellular basis of glioblastoma. *Genes Dev* 26, 756-784, doi:10.1101/gad.187922.112 (2012).

46 Liu, C. et al. Chemokine receptor CXCR3 promotes growth of glioma. *Carcinogenesis* 32, 129-137, doi:10.1093/carcin/bgq224 (2011).

47 Vivanco, I. et al. Differential sensitivity of glioma-versus lung cancer-specific EGFR mutations to EGFR kinase inhibitors. *Cancer Discov* 2, 458-471, doi:10.1158/2159-8290.CD-11-0284 (2012).

48 Forbes, S. A. et al. COSMIC (the Catalogue of Somatic Mutations in Cancer): a resource to investigate acquired mutations in human cancer. *Nucleic Acids Res* 38, D652-657, doi:10.1093/nar/gkp995 (2010).

49 Northcott, P. A. et al. Subgroup-specific structural variation across 1,000 medulloblastoma genomes. *Nature* 488, 49-56, doi:10.1038/nature11327 (2012).

Srivastava, M. et al. The *Amphimedon queenslandica* genome and the evolution of animal complexity. Nature 466, 720-726 (2010).

Stogios et al. Sequence and structural analysis of BTB domain proteins. Genome Biol. 6(10):R82 (2005).

Soding, J. Protein homology detection by HMM-HMM comparison. Bioinformatics. 21(7):951-60 (2005).

Annotations to Figures:

Annotation information in each column is described below for FIG. 27:

sample: Name of TCGA or private sample.

chrom5p: 5' chromosome start5p: 5' genomic start coordinate end5p: 5' genomic end coordinate chrom3p: 3' chromosome start3p: 3' genomic start coordinate end3p: 3' genomic end coordinate strand5p: 5' strand strand3p: 3' strand genes5p: 5' gene genes3p: 3' gene total_frags (split inserts+split reads): Total number of split inserts and split reads
spanning_frags (split reads): Number of split reads
GeneBreakpoint5p: The genomic coordinate of the breakpoint in the 5' gene
GeneBreakpoint3p: The genomic coordinate of the breakpoint in the 3' gene
FrameType: Reading frame of gene fusions. Values include in-frame, frameshift, or null (no transcript information was found in the Ensembl *Homo_sapiens*.GRCh37.60.gtf file).
FusedSequence: Reconstructed sequence of the fusion RNA transcript
ProteinStart5p: The start coordinate of the 5' protein segment
ProteinStop5p: The stop coordinate (breakpoint) of the 5' protein segment
ProteinStart3p: The start coordinate (breakpoint) of the 3' protein segment
ProteinStop3p: The stop coordinate of the 3' protein segment
ProteinSequence: Reconstructed sequence of the fusion protein
ExonBreak5p: The last exon of the 5' gene before the breakpoint
ExonBreak3p: The first exon of the 3' gene after the breakpoint Annotation information in each column is described below for FIG. 28:
sample: Name of TCGA sample
split reads: Total number of split reads
gene5p: 5' gene
chr5p: 5' chromosome
sense5p: 5' sense
start5p: 5' genomic start coordinate
end5p: 5' genomic end coordinate
breakpoint5p: 5' genomic coordinate of breakpoint
exonBeforeBreakpoint5p: Exon number of 5' gene before the breakpoint
gene3p: 3' gene
chr3p: 3' chromosome
sense3p: 3' sense
start3p: 3' genomic start coordinate
end3p: 3' genomic end coordinate
breakpoint3p: 3' genomic coordinate of breakpoint
exonAfterBreakpoint3p: Exon number of 3' gene after the breakpoint
split inserts: Total number of split inserts
posA5p: Coordinate of split insert read closest to 5' end in 5' gene
posB5p: Coordinate of split insert read closest to 3' end in 5' gene
readDir5p: Read direction of split insert reads in 5' gene
posA3p: Coordinate of split insert read closest to 5' end in 3' gene
posB3p: Coordinate of split insert read closest to 3' end in 3' gene
readDir3p: Read direction of split insert reads in 3' gene Annotation information in each column is described below for FIG. 31:
sample: Name of TCGA sample
split reads: Total number of split reads
gene5p: 5' gene
chr5p: 5' chromosome
sense5p: 5' sense
start5p: 5' genomic start coordinate
end5p: 5' genomic end coordinate
breakpoint5p: 5' genomic coordinate of breakpoint
exonBeforeBreakpoint5p: Exon number of 5' gene before the breakpoint
gene3p: 3' gene
chr3p: 3' chromosome
sense3p: 3' sense
start3p: 3' genomic start coordinate
end3p: 3' genomic end coordinate
breakpoint3p: 3' genomic coordinate of breakpoint
exonAfterBreakpoint3p: Exon number of 3' gene after the breakpoint
split inserts: Total number of split inserts
posA5p: Coordinate of split insert read closest to 5' end in 5' gene
posB5p: Coordinate of split insert read closest to 3' end in 5' gene
readDir5p: Read direction of split insert reads in 5' gene
posA3p: Coordinate of split insert read closest to 5' end in 3' gene
posB3p: Coordinate of split insert read closest to 3' end in 3' gene
readDir3p: Read direction of split insert reads in 3' gene.

---

SEQUENCE LISTING (8495 sequences)

SEQ ID NO: 1 - protein, 52 aa, Artificial Sequence
  Description of Artificial Sequence: Synthetic polypeptide
SRPKFRELIIEFSKMARDPQRYLVIQLQDKFEHLKMIQQEEIRKLEEEKKQL

SEQ ID NO: 2 - DNA, 157 bp, Artificial Sequence
  Description of Artificial Sequence: Synthetic polynucleotide
  CDS (1)..(156)
agtcgcccaaagttccgtgagttgatcatcgaattctccaaaatggcccgagacccccagcgctaccttgtcattcagctgcaggacaagttcgagcatcttaaaatgattcaacaggaggagataaggaagctcgaggaagagaaaaaacaactgg

SEQ ID NO: 3 - protein, 8 aa, Artificial Sequence
  Description of Artificial Sequence: Synthetic peptide
LVIQLQDK

SEQ ID NO: 4 - DNA, 24 bp, Artificial Sequence
  Description of Artificial Sequence: Synthetic oligonucleotide
  CDS (1)..(24)
cttgtcattcagctgcaggacaag

SEQ ID NO: 5 - protein, 1041 aa, Artificial Sequence
  Description of Artificial Sequence: Synthetic polypeptide
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQLQDKFEHLKMIQQEEIRKLEEEKKQLEGEIIDFYKMKAASEALQTQLSTDTKKDKHRKK

SEQ ID NO: 6 - skipped

SEQ ID NO: 7 - protein, 41 aa, Artificial Sequence
  Description of Artificial Sequence: Synthetic polypeptide
SRPKFRELIIEFSKMARDPQRYLVIQDAFIGFGGNVIRQQV

SEQ ID NO: 8 - DNA, 125 bp, Artificial Sequence
  Description of Artificial Sequence: Synthetic polynucleotide
  CDS (1)..(123)
agtcgcccaaagttccgtgagttgatcatcgaattctccaaaatggcccgagacccccagcgctaccttgtcattcaggatgctttcattggatttggaggaaatgtgatcaggcaacaagtcaa

SEQ ID NO: 9 - protein, 8 aa, Artificial Sequence
  Description of Artificial Sequence: Synthetic peptide
LVIQDAFI

SEQ ID NO: 10 - DNA, 24 bp, Artificial Sequence
  Description of Artificial Sequence: Synthetic oligonucleotide
  CDS (1)..(24)
cttgtcattcaggatgctttcatt

SEQ ID NO: 11 - protein, 1017 aa, Artificial Sequence
  Description of Artificial Sequence: Synthetic polypeptide
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQDAFIGFGGNVIRQQVKDNAKWYITDFVELLGELEE

SEQ ID NO: 12 - DNA, 21 bp, Artificial Sequence
  Description of Artificial Sequence: Synthetic primer
tccgagtccaggctgaaaatg

SEQ ID NO: 13 - protein, 52 aa, Artificial Sequence
  Description of Artificial Sequence: Synthetic polypeptide
  MOD_RES (52)..(52): Any amino acid
TSAIAKQEDVSVQLEALDIMADMLSRCTGPGLEGCPTNGPKIPSIATGMVGX

SEQ ID NO: 14 - DNA, 157 bp, Artificial Sequence
  Description of Artificial Sequence: Synthetic polynucleotide
  CDS (3)..(157)
ttacaagtgcaatagcaaaacaggaagatgtctctgttcagctagaagccttggatattatggctgatatgttgagcagatgcactgggccaggtcttgaaggctgtccaacgaatgggcctaagatcccgtccatcgccactgggatggtgggggc

SEQ ID NO: 15 - DNA, 24 bp, Artificial Sequence
  Description of Artificial Sequence: Synthetic oligonucleotide
  CDS (1)..(24)
atgttgagcagatgcactgggcca

SEQ ID NO: 16 - protein, 8 aa, Artificial Sequence
  Description of Artificial Sequence: Synthetic peptide
MLSRCTGP

SEQ ID NO: 17-29 - skipped (13 entries)

SEQ ID NO: 30 - DNA, 20 bp, Artificial Sequence
  Description of Artificial Sequence: Synthetic primer
agcgatgcgaccctccggga

SEQ ID NO: 31 - DNA, 25 bp, Artificial Sequence
  Description of Artificial Sequence: Synthetic primer
tcttacgatgtttgtctttctttgt

SEQ ID NO: 32 - DNA, 23 bp, Artificial Sequence
  Description of Artificial Sequence: Synthetic primer
gggtgactgtttgggagttgatg

SEQ ID NO: 33 - DNA, 25 bp, Artificial Sequence
  Description of Artificial Sequence: Synthetic primer
tgtttgtctttctttgtatcggtgc

SEQ ID NO: 34 - DNA, 20 bp, Artificial Sequence
  Description of Artificial Sequence: Synthetic primer
gtgatgtctggagctacggg

SEQ ID NO: 35 - DNA, 21 bp, Artificial Sequence
  Description of Artificial Sequence: Synthetic primer
tgcctgatcacatttcctcca

SEQ ID NO: 36 - DNA, 23 bp, Artificial Sequence
  Description of Artificial Sequence: Synthetic primer
agttccgtgtcattgccatcaac

SEQ ID NO: 37 - DNA, 23 bp, Artificial Sequence
  Description of Artificial Sequence: Synthetic primer
tgtttcgtccttcttctccaccg

SEQ ID NO: 38 - DNA, 22 bp, Artificial Sequence
  Description of Artificial Sequence: Synthetic primer
ggaaaaaatgacatccagcgac

SEQ ID NO: 39 - DNA, 22 bp, Artificial Sequence
  Description of Artificial Sequence: Synthetic primer
tgggtgtaagaggctccacaag

SEQ ID NO: 40 - DNA, 24 bp, Artificial Sequence
  Description of Artificial Sequence: Synthetic primer
ggatgatagacgcagatagtcgcc

SEQ ID NO: 41 - DNA, 24 bp, Artificial Sequence
  Description of Artificial Sequence: Synthetic primer
tccagttgttttttctcttcctcg

SEQ ID NO: 42 - DNA, 24 bp, Artificial Sequence
  Description of Artificial Sequence: Synthetic primer
aagggagaggggaccagaaagaac

SEQ ID NO: 43 - DNA, 23 bp, Artificial Sequence
  Description of Artificial Sequence: Synthetic primer
gaaaggaagaggcaggcaaagac

SEQ ID NO: 44 - DNA, 24 bp, Artificial Sequence
  Description of Artificial Sequence: Synthetic primer
gcaatagcaaaacaggaagatgtc

SEQ ID NO: 45 - DNA, 21 bp, Artificial Sequence
  Description of Artificial Sequence: Synthetic primer
gaacacttacccattcgttgg

SEQ ID NO: 46 - DNA, 21 bp, Homo sapiens
cctctgttcacgaacagcaga

SEQ ID NO: 47 - DNA, 21 bp, Homo sapiens
ttcctgcacaagattattgcg

SEQ ID NO: 48 - DNA, 21 bp, Homo sapiens
attctggtcacggtgtacata

SEQ ID NO: 49 - DNA, 21 bp, Homo sapiens
cctggaagatcgtgtccatga

SEQ ID NO: 50 - DNA, 21 bp, Homo sapiens
cacttgccacctggttgcctt

SEQ ID NO: 51 - DNA, 21 bp, Homo sapiens
ttccactctacaacttccttt

SEQ ID NO: 52 - DNA, 21 bp, Homo sapiens
caccaccatagtaaagtgctc

SEQ ID NO: 53 - DNA, 21 bp, Homo sapiens
cagagatgtcccggttctccg

SEQ ID NO: 54 - DNA, 21 bp, Homo sapiens
tcacctggtcgtgtgaggagc

SEQ ID NO: 55 - DNA, 21 bp, Homo sapiens
ctgagttggatctggtgactt

SEQ ID NO: 56 - DNA, 21 bp, Homo sapiens
ggggatccaagaatacctatc

SEQ ID NO: 57 - DNA, 21 bp, Homo sapiens
acctcaatgcgtttattcttg

SEQ ID NO: 58 - DNA, 21 bp, Homo sapiens
ctgctgctcccatcgttctct

SEQ ID NO: 59 - DNA, 21 bp, Homo sapiens
caccaagaatcagagaagagg

SEQ ID NO: 60 - DNA, 21 bp, Homo sapiens
aggctcctctgagactgtgga

SEQ ID NO: 61 - DNA, 21 bp, Homo sapiens
ggttcttctcggagaaggtct

SEQ ID NO: 62 - DNA, 21 bp, Homo sapiens
actcacatgttctgcccactg

SEQ ID NO: 63 - DNA, 21 bp, Homo sapiens
cagtgaagatccttttgtaga

SEQ ID NO: 64 - DNA, 21 bp, Homo sapiens
tgacgggagacggagtaacag

SEQ ID NO: 65 - DNA, 21 bp, Homo sapiens
gagctcctgacgggttacccc

SEQ ID NO: 66 - DNA, 21 bp, Homo sapiens
ctggattgtcgtacaggcatg

SEQ ID NO: 67 - DNA, 21 bp, Homo sapiens
tcagaaacaaggatggcgtgt

SEQ ID NO: 68 - DNA, 21 bp, Homo sapiens
gaccctggccgcctgagtccc

SEQ ID NO: 69 - DNA, 21 bp, Homo sapiens
tgggcaaagcggagccaaaat

SEQ ID NO: 70 - DNA, 21 bp, Homo sapiens
gccacatagacggctgcagtc

SEQ ID NO: 71 - DNA, 21 bp, Homo sapiens
gacaccatgatggagaggcct

SEQ ID NO: 72 - DNA, 21 bp, Homo sapiens
ttgggctcggcgccaggtggg

SEQ ID NO: 73 - DNA, 21 bp, Homo sapiens
ccctgggctccacctccactt

SEQ ID NO: 74 - DNA, 21 bp, Homo sapiens
gaagaagaaacgagagggaat

SEQ ID NO: 75 - DNA, 21 bp, Homo sapiens
ggttccccagggcctcaggtt

SEQ ID NO: 76 - DNA, 21 bp, Homo sapiens
tgtccaacttcggtggccagc

SEQ ID NO: 77 - DNA, 21 bp, Homo sapiens
aaggtctacgtagacaagctt

SEQ ID NO: 78 - DNA, 21 bp, Homo sapiens
agttggatatgagaggcgtgg

SEQ ID NO: 79 - DNA, 21 bp, Homo sapiens
aacccagttcgagcattaagt

SEQ ID NO: 80 - DNA, 21 bp, Homo sapiens
gctgggatggcgaaagccagc

SEQ ID NO: 81 - DNA, 21 bp, Homo sapiens
attttatacaccatgaggtga

SEQ ID NO: 82 - DNA, 21 bp, Homo sapiens
agactgctcctggtgcaggtg

SEQ ID NO: 83 - DNA, 21 bp, Homo sapiens
tgccgttcagcctccagctct

SEQ ID NO: 84 - DNA, 21 bp, Homo sapiens
cccattgccttcactggcact

SEQ ID NO: 85 - DNA, 21 bp, Homo sapiens
gcccaccctgcggtcgctgag

SEQ ID NO: 86 - DNA, 21 bp, Homo sapiens
tggtactgcacggtgaggttg

SEQ ID NO: 87 - DNA, 20 bp, Artificial Sequence
  Description of Artificial Sequence: Synthetic primer
agaggtgaccaccaatcagc

SEQ ID NO: 88 - DNA, 20 bp, Artificial Sequence
  Description of Artificial Sequence: Synthetic primer
cgtgtcccacacagagacag

SEQ ID NO: 89 - DNA, 25 bp, Artificial Sequence
  Description of Artificial Sequence: Synthetic primer
ctacttcctatctcaccccaaaagg

SEQ ID NO: 90 - DNA, 20 bp, Artificial Sequence
  Description of Artificial Sequence: Synthetic primer
tcccacatctcagacaagca

SEQ ID NO: 91 - DNA, 21 bp, Artificial Sequence
  Description of Artificial Sequence: Synthetic primer
tcaatggtgatggtgatgatg

SEQ ID NO: 92 - DNA, 22 bp, Artificial Sequence
  Description of Artificial Sequence: Synthetic primer
gaaggtgaaggtcggagtcaac

SEQ ID NO: 93 - DNA, 22 bp, Artificial Sequence
  Description of Artificial Sequence: Synthetic primer
cagagttaaaagcagccctggt

SEQ ID NO: 94 - DNA, 21 bp, Homo sapiens
gctttggtgccacctgcgtga

SEQ ID NO: 95 - DNA, 21 bp, Homo sapiens
cagatcatcagaggaaatatg

SEQ ID NO: 96 - DNA, 21 bp, Homo sapiens
ggtgaggatgggcctccggtt

SEQ ID NO: 97 - DNA, 21 bp, Homo sapiens
ataggtctgccgcaaattccg

SEQ ID NO: 98 - DNA, 21 bp, Homo sapiens
aatgtgagcacgttttttcat

SEQ ID NO: 99 - DNA, 21 bp, Homo sapiens
tctttgactcagttgtggaag

SEQ ID NO: 100 - DNA, 21 bp, Homo sapiens
cgacgaagaagctggtttctc

SEQ ID NO: 101 - DNA, 21 bp, Homo sapiens
caagctcccacagtgggccca

SEQ ID NO: 102 - DNA, 21 bp, Homo sapiens
cccacaaaacgatgggaaaca

SEQ ID NO: 103 - DNA, 21 bp, Homo sapiens
tcaaaatgaagatgctgtgaa

SEQ ID NO: 104 - DNA, 21 bp, Homo sapiens
cacatcaccaagcattacccc

SEQ ID NO: 105 - DNA, 21 bp, Homo sapiens
gattgcaaacctaggtcaggg

SEQ ID NO: 106 - DNA, 21 bp, Homo sapiens
agaacgagctctggtgctgga

SEQ ID NO: 107 - DNA, 21 bp, Homo sapiens
acatcaccaagcattacccct

SEQ ID NO: 108 - DNA, 21 bp, Homo sapiens
aactaaataagtagagaaagt

SEQ ID NO: 109 - DNA, 21 bp, Homo sapiens
ctatacttttgaactgttaac

SEQ ID NO: 110 - DNA, 21 bp, Homo sapiens
gcccctatcaagccacgatgg

SEQ ID NO: 111 - DNA, 21 bp, Homo sapiens
catcaccaagcattaccccta

SEQ ID NO: 112 - DNA, 21 bp, Homo sapiens
atcaccaagcattacccctac

SEQ ID NO: 113 - DNA, 21 bp, Homo sapiens
ttggccaacaatgtctcaaac

SEQ ID NO: 114 - DNA, 21 bp, Homo sapiens
gtcagactctaaagacacctc

SEQ ID NO: 115 - DNA, 21 bp, Homo sapiens
gaggtggtccttgggaatttg

SEQ ID NO: 116 - DNA, 21 bp, Homo sapiens
catcctgtacgcttttaggtg

SEQ ID NO: 117 - DNA, 21 bp, Homo sapiens
gtgctccgggcgctgccgtgg

SEQ ID NO: 118 - DNA, 21 bp, Homo sapiens
cccctatcaagccacgatggt

SEQ ID NO: 119 - DNA, 21 bp, Homo sapiens
ggaagatggtctggaaagaga

SEQ ID NO: 120 - DNA, 21 bp, Homo sapiens
tcctacagatgcactgggcca

SEQ ID NO: 121 - DNA, 21 bp, Homo sapiens
cctgcaagtcctaataaaatt

SEQ ID NO: 122 - DNA, 21 bp, Homo sapiens
gatgggcctccggttcatgcc

SEQ ID NO: 123 - DNA, 21 bp, Homo sapiens
tttctgtcagagtatttactt

SEQ ID NO: 124 - DNA, 21 bp, Homo sapiens
acatatttctatggaaaattt

SEQ ID NO: 125 - DNA, 21 bp, Homo sapiens
gccgtcgtctcaaatactttt

SEQ ID NO: 126 - DNA, 21 bp, Homo sapiens
ccctatcaagccacgatggtg

SEQ ID NO: 127 - DNA, 21 bp, Homo sapiens
caccaagcattacccctacta

SEQ ID NO: 128 - DNA, 21 bp, Homo sapiens
actctaaagacacctcaggta

SEQ ID NO: 129 - DNA, 21 bp, Homo sapiens
ggaactgttacacatgtagtt

SEQ ID NO: 130 - DNA, 21 bp, Homo sapiens
gcttctaggcgtcttgccaac

SEQ ID NO: 131 - DNA, 21 bp, Homo sapiens
cctatcaagccacgatggtgg

SEQ ID NO: 132 - DNA, 21 bp, Homo sapiens
ctctaaagacacctcaggtat

SEQ ID NO: 133 - DNA, 21 bp, Homo sapiens
ccaagcattacccctactacc

SEQ ID NO: 134 - DNA, 21 bp, Homo sapiens
gggaccttcttacccacaaac

SEQ ID NO: 135 - DNA, 21 bp, Homo sapiens
aaccagatacaggaatggtga

SEQ ID NO: 136 - DNA, 21 bp, Homo sapiens
ggggcactcatgcggcaggct

SEQ ID NO: 137 - DNA, 21 bp, Homo sapiens
tgtccacatcggcttggagct

SEQ ID NO: 138 - DNA, 21 bp, Homo sapiens
tgcccggcaggagtcatggga

SEQ ID NO: 139 - DNA, 21 bp, Homo sapiens
tcctcttggacgggattgatg

SEQ ID NO: 140 - DNA, 21 bp, Homo sapiens
aaaaggaaaacgaatagtttt

SEQ ID NO: 141 - DNA, 21 bp, Homo sapiens
cgttgtcaacgttgcggaatg

SEQ ID NO: 142 - DNA, 21 bp, Homo sapiens
ttcgccgtcgtctcaaatact

SEQ ID NO: 143 - DNA, 21 bp, Homo sapiens
tctaaagacacctcaggtatt

SEQ ID NO: 144 - DNA, 21 bp, Homo sapiens
ttccccagatgatctttccat

SEQ ID NO: 145 - DNA, 21 bp, Homo sapiens
aataatgaatgaagatgagag

SEQ ID NO: 146 - DNA, 21 bp, Homo sapiens
tcggataagatgctgaggagg

SEQ ID NO: 147 - DNA, 21 bp, Homo sapiens
caagcattacccctactaccg

SEQ ID NO: 148 - DNA, 21 bp, Homo sapiens
gtgtggtggcggttgtagaga

SEQ ID NO: 149 - DNA, 21 bp, Homo sapiens
ctgctgctcccatcgttctct

SEQ ID NO: 150 - DNA, 21 bp, Homo sapiens
cttcgccgtcgtctcaaatac

SEQ ID NO: 151 - DNA, 21 bp, Homo sapiens
gctcgaagcagcagattcttg

SEQ ID NO: 152 - DNA, 21 bp, Homo sapiens
gaatttggaagagtcttactg

SEQ ID NO: 153 - DNA, 21 bp, Homo sapiens
tacaatctcaacaccttcatt

SEQ ID NO: 154 - DNA, 21 bp, Homo sapiens
tattctttaggactagaataa

SEQ ID NO: 155 - DNA, 21 bp, Homo sapiens
tatcaagccacgatggtggac

SEQ ID NO: 156 - DNA, 21 bp, Homo sapiens
ttggccagttggcaaaacatc

SEQ ID NO: 157 - DNA, 21 bp, Homo sapiens
gtgcaaggacacctgcccccc

SEQ ID NO: 158 - DNA, 21 bp, Homo sapiens
gacacaaaattccaaaagctg

SEQ ID NO: 159 - DNA, 21 bp, Homo sapiens
gttggaacgggagtttaagtc

SEQ ID NO: 160 - DNA, 21 bp, Homo sapiens
atagaggcagaagagcaacag

SEQ ID NO: 161 - DNA, 21 bp, Homo sapiens
agggtcccaattgacatgagg

SEQ ID NO: 162 - DNA, 21 bp, Homo sapiens
gattaagaataacctttgatt

SEQ ID NO: 163 - DNA, 21 bp, Homo sapiens
agggccttgccgcaaaggtag

SEQ ID NO: 164 - DNA, 21 bp, Homo sapiens
atccaaagacccgcttcatct

SEQ ID NO: 165 - DNA, 21 bp, Homo sapiens
aatttccgccgtctcagtgag

SEQ ID NO: 166 - DNA, 21 bp, Homo sapiens
ttctgtttttctttggttgct

SEQ ID NO: 167 - DNA, 21 bp, Homo sapiens
ccatctgaagctgtgatgatc

SEQ ID NO: 168 - DNA, 21 bp, Homo sapiens
gcccccgctgcggttctcgga

SEQ ID NO: 169 - DNA, 21 bp, Homo sapiens
gggccctggcgggcctgacac

SEQ ID NO: 170 - DNA, 21 bp, Homo sapiens
ccttcgccgtcgtctcaaata

SEQ ID NO: 171 - DNA, 21 bp, Homo sapiens
ctaaagacacctcaggtatta

SEQ ID NO: 172 - DNA, 21 bp, Homo sapiens
acacaaaattccaaaagctgc

SEQ ID NO: 173 - DNA, 21 bp, Homo sapiens
ggcacaaacacgcacctcaaa

SEQ ID NO: 174 - DNA, 21 bp, Homo sapiens
gctacatccccgcagcgggga

SEQ ID NO: 175 - DNA, 21 bp, Homo sapiens
tccaagatgacgaagcttcat

SEQ ID NO: 176 - DNA, 21 bp, Homo sapiens
cgaagcagcagattcttgttt

SEQ ID NO: 177 - DNA, 21 bp, Homo sapiens
aggcgttcctgagggggtccg

SEQ ID NO: 178 - DNA, 21 bp, Homo sapiens
atttagccagcgatggctagc

SEQ ID NO: 179 - DNA, 21 bp, Homo sapiens
tgattgacctgttgtccacaa

SEQ ID NO: 180 - DNA, 21 bp, Homo sapiens
agttggaacgggagtttaagt

SEQ ID NO: 181 - DNA, 21 bp, Homo sapiens
gctgaggcaggcatcaggcac

SEQ ID NO: 182 - DNA, 21 bp, Homo sapiens
gtactcttcttgtccagctgt

SEQ ID NO: 183 - DNA, 21 bp, Homo sapiens
cacaaaattccaaaagctgca

SEQ ID NO: 184 - DNA, 21 bp, Homo sapiens
cacagccacggccactgtggc

SEQ ID NO: 185 - DNA, 21 bp, Homo sapiens
cagttggaacgggagtttaag

SEQ ID NO: 186 - DNA, 21 bp, Homo sapiens
ttttaagtacattgatggaaa

SEQ ID NO: 187 - DNA, 21 bp, Homo sapiens
aagcattacccctactaccgg

SEQ ID NO: 188 - DNA, 21 bp, Homo sapiens
gtgcttgcttcgctaaggtca

SEQ ID NO: 189 - DNA, 21 bp, Homo sapiens
agacttctccagagaaaagta

SEQ ID NO: 190 - DNA, 21 bp, Homo sapiens
ctggttgtttggacccacatc

SEQ ID NO: 191 - DNA, 21 bp, Homo sapiens
agcagcagattcttgttttta

SEQ ID NO: 192 - DNA, 21 bp, Homo sapiens
tttactgtcatgcttatgctt

SEQ ID NO: 193 - DNA, 21 bp, Homo sapiens
gagaggagctggtgttgttgg

SEQ ID NO: 194 - DNA, 21 bp, Homo sapiens
tcaagccacgatggtggacat

SEQ ID NO: 195 - DNA, 21 bp, Homo sapiens
cactgattcgaattgaagagg

SEQ ID NO: 196 - DNA, 21 bp, Homo sapiens
gtcctgaacacggtggagcta

SEQ ID NO: 197 - DNA, 21 bp, Homo sapiens
aaagacacctcaggtattaca

SEQ ID NO: 198 - DNA, 21 bp, Homo sapiens
agcaaagaggtatatggtagg

SEQ ID NO: 199 - DNA, 21 bp, Homo sapiens
agctgaggcaaggtaccctat

SEQ ID NO: 200 - DNA, 21 bp, Homo sapiens
cattttgggacagaatggaat

SEQ ID NO: 201 - DNA, 21 bp, Homo sapiens
caggagtccacgcaggtgcta

SEQ ID NO: 202 - DNA, 21 bp, Homo sapiens
gcagcagattcttgtttttaa

SEQ ID NO: 203 - DNA, 21 bp, Homo sapiens
gtacaagaccggagatgtgcc

SEQ ID NO: 204 - DNA, 21 bp, Homo sapiens
actactatcattatctcctgt

SEQ ID NO: 205 - DNA, 21 bp, Homo sapiens
gtccccttcagcactggccga

SEQ ID NO: 206 - DNA, 21 bp, Homo sapiens
ccagttggaacgggagtttaa

SEQ ID NO: 207 - DNA, 21 bp, Homo sapiens
gatgaatttcaggttgccgct

SEQ ID NO: 208 - DNA, 21 bp, Homo sapiens
cagctggtatatggtggcttt

SEQ ID NO: 209 - DNA, 21 bp, Homo sapiens
tttcaacagcgtccatcatgc

SEQ ID NO: 210 - DNA, 21 bp, Homo sapiens
cggtcttggcgttgccaaagg

SEQ ID NO: 211 - DNA, 21 bp, Homo sapiens
ggccagacctaagagcaatca

SEQ ID NO: 212 - DNA, 21 bp, Homo sapiens
acaaaattccaaaagctgcaa

SEQ ID NO: 213 - DNA, 21 bp, Homo sapiens
atcatcgatcaccaacaggat

SEQ ID NO: 214 - DNA, 21 bp, Homo sapiens
tgtagactgctctctacggcc

SEQ ID NO: 215 - DNA, 21 bp, Homo sapiens
agccccatccaccaccaatgc

SEQ ID NO: 216 - DNA, 21 bp, Homo sapiens
cagcaggacacgcccggaagc

SEQ ID NO: 217 - DNA, 21 bp, Homo sapiens
gtccccttcagcactggccga

SEQ ID NO: 218 - DNA, 21 bp, Homo sapiens
tctctgctaggcagctggtgg

SEQ ID NO: 219 - DNA, 21 bp, Homo sapiens
ctggattgtcgtacaggcatg

SEQ ID NO: 220 - DNA, 21 bp, Homo sapiens
gcatcagcgagaaatagttga

SEQ ID NO: 221 - DNA, 21 bp, Homo sapiens
tttgccatcacggttgaagtc

SEQ ID NO: 222 - DNA, 21 bp, Homo sapiens
tatgtgtattattatagctac

SEQ ID NO: 223 - DNA, 21 bp, Homo sapiens
cagcagattcttgtttttaag

SEQ ID NO: 224 - DNA, 21 bp, Homo sapiens
tatcaaagcattgtccttcca

SEQ ID NO: 225 - DNA, 22 bp, Homo sapiens
acagggcaggtcttggccagtt

SEQ ID NO: 226 - DNA, 21 bp, Homo sapiens
gagaggttgggtctgcatctt

SEQ ID NO: 227 - DNA, 21 bp, Homo sapiens
gccagttggaacgggagttta

SEQ ID NO: 228 - DNA, 21 bp, Homo sapiens
caagccacgatggtggacatc

SEQ ID NO: 229 - DNA, 21 bp, Homo sapiens
cccatctaggcagccagaagc

SEQ ID NO: 230 - DNA, 21 bp, Homo sapiens
caaaattccaaaagctgcaat

SEQ ID NO: 231 - DNA, 21 bp, Homo sapiens
ctcacgcctcgttggacagat

SEQ ID NO: 232 - DNA, 21 bp, Homo sapiens
catgtagttgtagtggatggt

SEQ ID NO: 233 - DNA, 21 bp, Homo sapiens
ggcaaaacatcttgttgaggg

SEQ ID NO: 234 - DNA, 21 bp, Homo sapiens
gctacctggacgaggagctgg

SEQ ID NO: 235 - DNA, 21 bp, Homo sapiens
agaaacagttctaggcaaaag

SEQ ID NO: 236 - DNA, 21 bp, Homo sapiens
aggcggctcatagggcaccac

SEQ ID NO: 237 - DNA, 21 bp, Homo sapiens
gctggacatcgtgctctgcct

SEQ ID NO: 238 - DNA, 21 bp, Homo sapiens
ggtgcttggcccttcctgttc

SEQ ID NO: 239 - DNA, 21 bp, Homo sapiens
cttggcgtaggatgagtccat

SEQ ID NO: 240 - DNA, 21 bp, Homo sapiens
tgaaatgaccgtcacaggtat

SEQ ID NO: 241 - DNA, 21 bp, Homo sapiens
agcaaagaggtatatggtagg

SEQ ID NO: 242 - DNA, 21 bp, Homo sapiens
agccaggatcgacgcacacac

SEQ ID NO: 243 - DNA, 21 bp, Homo sapiens
aggctcctctgagactgtgga

SEQ ID NO: 244 - DNA, 21 bp, Homo sapiens
agtaagctccgtgctcgtgag

SEQ ID NO: 245 - DNA, 21 bp, Homo sapiens
gtgcagccatgtccactgcca

SEQ ID NO: 246 - DNA, 21 bp, Homo sapiens
aatcttgtccgctacgttcgc

SEQ ID NO: 247 - DNA, 21 bp, Homo sapiens
gtaaaatggacatacctaata

SEQ ID NO: 248 - DNA, 21 bp, Homo sapiens
agcattacccctactaccgga

SEQ ID NO: 249 - DNA, 21 bp, Homo sapiens
caaagcgccagacaaacctat

SEQ ID NO: 250 - DNA, 21 bp, Homo sapiens
gattggaaaacgagccaatga

SEQ ID NO: 251 - DNA, 21 bp, Homo sapiens
agacacctcaggtattacagg

SEQ ID NO: 252 - DNA, 21 bp, Homo sapiens
agcagattcttgtttttaaga

SEQ ID NO: 253 - DNA, 21 bp, Homo sapiens
ctgtagactgctctctacggc

SEQ ID NO: 254 - DNA, 21 bp, Homo sapiens
taggcatcagcgagaaatagt

SEQ ID NO: 255 - DNA, 21 bp, Homo sapiens
agctgatctcggtgacctaca

SEQ ID NO: 256 - DNA, 21 bp, Homo sapiens
tccccacttcgttaaagtaga

SEQ ID NO: 257 - DNA, 21 bp, Homo sapiens
ggccagttggaacgggagttt

SEQ ID NO: 258 - DNA, 21 bp, Homo sapiens
gctggtcccccaagtcaccgg

SEQ ID NO: 259 - DNA, 21 bp, Homo sapiens
tctcaattcccccaatcacgc

SEQ ID NO: 260 - DNA, 21 bp, Homo sapiens
aatctgatgcatagaatcatt

SEQ ID NO: 261 - DNA, 21 bp, Homo sapiens
ccccaggcccgctcagcaggg

SEQ ID NO: 262 - DNA, 21 bp, Homo sapiens
caggcagctgacagctttaaa

SEQ ID NO: 263 - DNA, 21 bp, Homo sapiens
ctaaaatgatagaggcagaag

SEQ ID NO: 264 - DNA, 21 bp, Homo sapiens
gactgatgtagaacccttgac

SEQ ID NO: 265 - DNA, 21 bp, Homo sapiens
ctacacttagccaaaggtcaa

SEQ ID NO: 266 - DNA, 21 bp, Homo sapiens
gaaagtagtccagaaagatcc

SEQ ID NO: 267 - DNA, 21 bp, Homo sapiens
gttctgttatccctgatcatg

SEQ ID NO: 268 - DNA, 21 bp, Homo sapiens
agcctttaggaaatcctttcg

SEQ ID NO: 269 - DNA, 21 bp, Homo sapiens
gcaaaaaaacggaagcgtgaa

SEQ ID NO: 270 - DNA, 21 bp, Homo sapiens
gtgaggaggacgaagaattca

SEQ ID NO: 271 - DNA, 21 bp, Homo sapiens
ggtattgaaaattcatgtcct

SEQ ID NO: 272 - DNA, 21 bp, Homo sapiens
taaactttttgacctgagaga

SEQ ID NO: 273 - DNA, 21 bp, Homo sapiens
taggcatcagcgagaaatagt

SEQ ID NO: 274 - DNA, 21 bp, Homo sapiens
aagaaaagccagattaggagg

SEQ ID NO: 275 - DNA, 21 bp, Homo sapiens
agaaacctgtggaatactctg

SEQ ID NO: 276 - DNA, 21 bp, Homo sapiens
tgtggtcacctgtgctgtttt

SEQ ID NO: 277 - DNA, 21 bp, Homo sapiens
aaaattccaaaagctgcaata

SEQ ID NO: 278 - DNA, 21 bp, Homo sapiens
ggtgttagatttgtcatttcc

SEQ ID NO: 279 - DNA, 21 bp, Homo sapiens
agtccctgggctcattctgca

SEQ ID NO: 280 - DNA, 21 bp, Homo sapiens
tttttgtgaccctgtccatca

SEQ ID NO: 281 - DNA, 21 bp, Homo sapiens
gccgaagaaagacctgccttc

SEQ ID NO: 282 - DNA, 21 bp, Homo sapiens
gccacacttggggttctttct

SEQ ID NO: 283 - DNA, 21 bp, Homo sapiens
aagggaaatcagcggtaagcc

SEQ ID NO: 284 - DNA, 21 bp, Homo sapiens
ttcaaagccagcaatgtccaa

SEQ ID NO: 285 - DNA, 21 bp, Homo sapiens
aagaagtggacgtagagattg

SEQ ID NO: 286 - DNA, 21 bp, Homo sapiens
aagccacgatggtggacatcc

SEQ ID NO: 287 - DNA, 21 bp, Homo sapiens
gaagatgttccgctgggcagg

SEQ ID NO: 288 - DNA, 21 bp, Homo sapiens
gtagagcgtcgtcttctcaca

SEQ ID NO: 289 - DNA, 21 bp, Homo sapiens
gagagacctctgcagtctgct

SEQ ID NO: 290 - DNA, 20 bp, Homo sapiens
tccactggctggcggagagg

SEQ ID NO: 291 - DNA, 21 bp, Homo sapiens
atcccctctcgtatgactatt

SEQ ID NO: 292 - DNA, 21 bp, Homo sapiens
ataggagagggtggcgacagt

SEQ ID NO: 293 - DNA, 21 bp, Homo sapiens
tgttttgcagaagcaaggtgc

SEQ ID NO: 294 - DNA, 21 bp, Homo sapiens
ctgcgggaagaccttcgccac

SEQ ID NO: 295 - DNA, 21 bp, Homo sapiens
gcctttaggaaatcctttcgg

SEQ ID NO: 296 - DNA, 21 bp, Homo sapiens
tcttggcgtaggatgagtcca

SEQ ID NO: 297 - DNA, 21 bp, Homo sapiens
aatcgcatttgtggttttcta

SEQ ID NO: 298 - DNA, 21 bp, Homo sapiens
tttcagtacctgcttggtgga

SEQ ID NO: 299 - DNA, 21 bp, Homo sapiens
tgtaatgatatgtgcatattt

SEQ ID NO: 300 - DNA, 21 bp, Homo sapiens
ctgcaaacacgccaacacaga

SEQ ID NO: 301 - DNA, 21 bp, Homo sapiens
acgaagaaccgtccctcattc

SEQ ID NO: 302 - DNA, 21 bp, Homo sapiens
gtgttgccccgttactgtcct

SEQ ID NO: 303 - DNA, 21 bp, Homo sapiens
caaagccaaccgatacttttc

SEQ ID NO: 304 - DNA, 21 bp, Homo sapiens
acctgaaggagtttctgcaga

SEQ ID NO: 305 - DNA, 21 bp, Homo sapiens
gacacctcaggtattacaggt

SEQ ID NO: 306 - DNA, 21 bp, Homo sapiens
gttcaaggagtttgtccagag

SEQ ID NO: 307 - DNA, 21 bp, Homo sapiens
aagcctacaaatatatcactg

SEQ ID NO: 308 - DNA, 21 bp, Homo sapiens
tgcccggcaggagtcatggga

SEQ ID NO: 309 - DNA, 21 bp, Homo sapiens
gggccagttggaacgggagtt

SEQ ID NO: 310 - DNA, 21 bp, Homo sapiens
aggccctcctattacccaggc

SEQ ID NO: 311 - DNA, 21 bp, Homo sapiens
gtctaatttcgaagagagacc

SEQ ID NO: 312 - DNA, 21 bp, Homo sapiens
aaaagggcaccaagcggggag

SEQ ID NO: 313 - DNA, 21 bp, Homo sapiens
tccaggcagctgacagcttta

SEQ ID NO: 314 - DNA, 21 bp, Homo sapiens
tggaagacagccagctctgta

SEQ ID NO: 315 - DNA, 21 bp, Homo sapiens
ccaactgttcgtacactggcc

SEQ ID NO: 316 - DNA, 21 bp, Homo sapiens
gcagcccaccgcccagacgtc

SEQ ID NO: 317 - DNA, 21 bp, Homo sapiens
agacgagggcgaacaggagga

SEQ ID NO: 318 - DNA, 21 bp, Homo sapiens
cagattcttgtttttaagatc

SEQ ID NO: 319 - DNA, 21 bp, Homo sapiens
gatgaagcctacaaatatatc

SEQ ID NO: 320 - DNA, 21 bp, Homo sapiens
cctgggcgggctcctcctcct

SEQ ID NO: 321 - DNA, 21 bp, Homo sapiens
tgataataagatcatccacag

SEQ ID NO: 322 - DNA, 21 bp, Homo sapiens
ccatgtagcgcgccagccggg

SEQ ID NO: 323 - DNA, 21 bp, Homo sapiens
gctattcagttcatctattga

SEQ ID NO: 324 - DNA, 21 bp, Homo sapiens
aattcacagctctcagcagtg

SEQ ID NO: 325 - DNA, 21 bp, Homo sapiens
ccctcctttttcatgatgcca

SEQ ID NO: 326 - DNA, 21 bp, Homo sapiens
gaggcacctggtctacaggat

SEQ ID NO: 327 - DNA, 21 bp, Homo sapiens
gctaaaatgatagaggcagaa

SEQ ID NO: 328 - DNA, 21 bp, Homo sapiens
catgtcaagaggggcagcaac

SEQ ID NO: 329 - DNA, 21 bp, Homo sapiens
atttgccaacgtctcatgcag

SEQ ID NO: 330 - DNA, 21 bp, Homo sapiens
atctcaaggttggtcagccta

SEQ ID NO: 331 - DNA, 21 bp, Homo sapiens
ctccttgagcggaccaccacc

SEQ ID NO: 332 - DNA, 21 bp, Homo sapiens
ctttaggaaatcctttcggct

SEQ ID NO: 333 - DNA, 21 bp, Homo sapiens
cctttaggaaatcctttcggc

SEQ ID NO: 334 - DNA, 21 bp, Homo sapiens
atcttggcgtaggatgagtcc

SEQ ID NO: 335 - DNA, 21 bp, Homo sapiens
cttagcggtggctagagtgga

SEQ ID NO: 336 - DNA, 21 bp, Homo sapiens
tgtaccaagcataggagaaaa

SEQ ID NO: 337 - DNA, 21 bp, Homo sapiens
gacttctcaacgaagcacgga

SEQ ID NO: 338 - DNA, 21 bp, Homo sapiens
ctgattcgaattgaagaggat

SEQ ID NO: 339 - DNA, 21 bp, Homo sapiens
gtggcctcccgagaacagctt

SEQ ID NO: 340 - DNA, 21 bp, Homo sapiens
ttcagaccctcagatgtaaca

SEQ ID NO: 341 - DNA, 21 bp, Homo sapiens
taaacataagagaattcatac

SEQ ID NO: 342 - DNA, 21 bp, Homo sapiens
cggaggtggtgcctgtaactg

SEQ ID NO: 343 - DNA, 22 bp, Homo sapiens
gccatcagattatgtcaggagg

SEQ ID NO: 344 - DNA, 21 bp, Homo sapiens
ggcctttggcgttgaattgaa

SEQ ID NO: 345 - DNA, 21 bp, Homo sapiens
cctctgttcacgaacagcaga

SEQ ID NO: 346 - DNA, 21 bp, Homo sapiens
gggtttctcccctgtgtgtgt

SEQ ID NO: 347 - DNA, 21 bp, Homo sapiens
agaacagaaccctgagactgt

SEQ ID NO: 348 - DNA, 21 bp, Homo sapiens
tttcctgtagactgctctcta

SEQ ID NO: 349 - DNA, 21 bp, Homo sapiens
ttcctgtagactgctctctac

SEQ ID NO: 350 - DNA, 21 bp, Homo sapiens
agttcaaggagtttgtccaga

SEQ ID NO: 351 - DNA, 21 bp, Homo sapiens
tggtgttagatttgtcatttc

SEQ ID NO: 352 - DNA, 21 bp, Homo sapiens
ataaggactattttcccatga

SEQ ID NO: 353 - DNA, 21 bp, Homo sapiens
gtgtcctcctcaccagttgtt

SEQ ID NO: 354 - DNA, 21 bp, Homo sapiens
gtcccatctccgcccagagcc

SEQ ID NO: 355 - DNA, 21 bp, Homo sapiens
agcaaagaggtatatggtagg

SEQ ID NO: 356 - DNA, 23 bp, Homo sapiens
tggggcctctgcagcctctacag

SEQ ID NO: 357 - DNA, 21 bp, Homo sapiens
tgatgttcacgcctttcttca

SEQ ID NO: 358 - DNA, 21 bp, Homo sapiens
gcatcataggcttcccggagc

SEQ ID NO: 359 - DNA, 21 bp, Homo sapiens
ctttgggctcgactagataga

SEQ ID NO: 360 - DNA, 21 bp, Homo sapiens
gccaccactcgcagacccaca

SEQ ID NO: 361 - DNA, 21 bp, Homo sapiens
agagacgagacccacgggagc

SEQ ID NO: 362 - DNA, 21 bp, Homo sapiens
ctgaaggagtttctgcagatt

SEQ ID NO: 363 - DNA, 21 bp, Homo sapiens
gttgctttggggtgctccctg

SEQ ID NO: 364 - DNA, 21 bp, Homo sapiens
aaattccaaaagctgcaatat

SEQ ID NO: 365 - DNA, 21 bp, Homo sapiens
gagtgctgggcggtcggatgg

SEQ ID NO: 366 - DNA, 21 bp, Homo sapiens
acccagtcccacactatcacc

SEQ ID NO: 367 - DNA, 21 bp, Homo sapiens
tatggaaagaaggggcctgtt

SEQ ID NO: 368 - DNA, 21 bp, Homo sapiens
ggtcctggttgctcccagagg

SEQ ID NO: 369 - DNA, 21 bp, Homo sapiens
tttcaccagggcagccatggg

SEQ ID NO: 370 - DNA, 21 bp, Homo sapiens
tggagaggttacttttctgcc

SEQ ID NO: 371 - DNA, 21 bp, Homo sapiens
ccagaaggctcggattgtggg

SEQ ID NO: 372 - DNA, 21 bp, Homo sapiens
ggctggccaggctccaaccct

SEQ ID NO: 373 - DNA, 21 bp, Homo sapiens
ccgctgggctcggatgacatg

SEQ ID NO: 374 - DNA, 21 bp, Homo sapiens
agattccagcaagattatgga

SEQ ID NO: 375 - DNA, 21 bp, Homo sapiens
ctggataaccccagaacctct

SEQ ID NO: 376 - DNA, 21 bp, Homo sapiens
tgaatgaagaattcctgggca

SEQ ID NO: 377 - DNA, 21 bp, Homo sapiens
tgcagagtccgaagtcagtaa

SEQ ID NO: 378 - DNA, 21 bp, Homo sapiens
ctctgggaagcgtgaaccatt

SEQ ID NO: 379 - DNA, 21 bp, Homo sapiens
gaatatgctcgaattgctgga

SEQ ID NO: 380 - DNA, 21 bp, Homo sapiens
ctctgagcccgagtcttcttg

SEQ ID NO: 381 - DNA, 21 bp, Homo sapiens
ccagtctccggaggctccggg

SEQ ID NO: 382 - DNA, 21 bp, Homo sapiens
ctccaggcagctgacagcttt

SEQ ID NO: 383 - DNA, 21 bp, Homo sapiens
tgctaaaatgatagaggcaga

SEQ ID NO: 384 - DNA, 21 bp, Homo sapiens
tgaaggagtttctgcagattg

SEQ ID NO: 385 - DNA, 21 bp, Homo sapiens
atgtcaagaggggcagcaaca

SEQ ID NO: 386 - DNA, 21 bp, Homo sapiens
tgtcaagaggggcagcaacac

SEQ ID NO: 387 - DNA, 21 bp, Homo sapiens
gatactttgtggaccacaata

SEQ ID NO: 388 - DNA, 21 bp, Homo sapiens
ccgcatctccgcacactctct

SEQ ID NO: 389 - DNA, 21 bp, Homo sapiens
actgcgggaagaccttcgcca

SEQ ID NO: 390 - DNA, 21 bp, Homo sapiens
gagtgctgggcggtcggatgg

SEQ ID NO: 391 - DNA, 21 bp, Homo sapiens
gcatgatctggtgctcaacaa

SEQ ID NO: 392 - DNA, 21 bp, Homo sapiens
gccaggactcgcctctgcaca

SEQ ID NO: 393 - DNA, 21 bp, Homo sapiens
ccgtggagccgcgacttggtg

SEQ ID NO: 394 - DNA, 21 bp, Homo sapiens
tcatttcaccagggcagccat

SEQ ID NO: 395 - DNA, 21 bp, Homo sapiens
aaaaattcaattcatttcacc

SEQ ID NO: 396 - DNA, 21 bp, Homo sapiens
ctcctgtcaggcacctttcag

SEQ ID NO: 397 - DNA, 21 bp, Homo sapiens
atgaggtccacgtttttgcct

SEQ ID NO: 398 - DNA, 21 bp, Homo sapiens
gaagtggcaagcaatggatcc

SEQ ID NO: 399 - DNA, 23 bp, Homo sapiens
gatctcctcagatgatgatgctg

SEQ ID NO: 400 - DNA, 21 bp, Homo sapiens
taagggtcccgcgccaggcag

SEQ ID NO: 401 - DNA, 21 bp, Homo sapiens
tggaaagggacgaactggtgt

SEQ ID NO: 402 - DNA, 21 bp, Homo sapiens
aatggtgactgttgtgagctg

SEQ ID NO: 403 - DNA, 21 bp, Homo sapiens
gccactaagcgatccttctgt

SEQ ID NO: 404 - DNA, 21 bp, Homo sapiens
tggggactgcgttgtttaaaa

SEQ ID NO: 405 - DNA, 21 bp, Homo sapiens
gggaatcttctggttcggtgc

SEQ ID NO: 406 - DNA, 21 bp, Homo sapiens
cgacgatgagcccgagcctgg

SEQ ID NO: 407 - DNA, 21 bp, Homo sapiens
gctgttgctttggggtgctcc

SEQ ID NO: 408 - DNA, 21 bp, Homo sapiens
gtcactttactgataactgtc

SEQ ID NO: 409 - DNA, 21 bp, Homo sapiens
agattcttgtttttaagatct

SEQ ID NO: 410 - DNA, 21 bp, Homo sapiens
aagttcaaggagtttgtccag

SEQ ID NO: 411 - DNA, 21 bp, Homo sapiens
tcgagaaccagcagcatctgc

SEQ ID NO: 412 - DNA, 21 bp, Homo sapiens
tcacctgggcagcacagatgc

SEQ ID NO: 413 - DNA, 21 bp, Homo sapiens
agcaaagaggtatatggtagg

SEQ ID NO: 414 - DNA, 21 bp, Homo sapiens
tgccacctgtgccatccaaac

SEQ ID NO: 415 - DNA, 23 bp, Homo sapiens
ggcgcagggactcaagccacaac

SEQ ID NO: 416 - DNA, 21 bp, Homo sapiens
cgaaacagctgcccggacctc

SEQ ID NO: 417 - DNA, 21 bp, Homo sapiens
ttcaacgacacggccaatgtg

SEQ ID NO: 418 - DNA, 21 bp, Homo sapiens
aacgccgtgtctaggggactt

SEQ ID NO: 419 - DNA, 21 bp, Homo sapiens
attcacagctctcagcagtga

SEQ ID NO: 420 - DNA, 21 bp, Homo sapiens
tgggccagttggaacgggagt

SEQ ID NO: 421 - DNA, 21 bp, Homo sapiens
acgccttgatggtaagtgcat

SEQ ID NO: 422 - DNA, 21 bp, Homo sapiens
taggtattcacagagagtggg

SEQ ID NO: 423 - DNA, 21 bp, Homo sapiens
tgaccaagtcgagctccatca

SEQ ID NO: 424 - DNA, 21 bp, Homo sapiens
agaggccagccgtatacgtat

SEQ ID NO: 425 - DNA, 21 bp, Homo sapiens
ggatgccctggaatgggatga

SEQ ID NO: 426 - DNA, 21 bp, Homo sapiens
tggaagctttaccttcgccat

SEQ ID NO: 427 - DNA, 21 bp, Homo sapiens
ccattttgtcgtccgacaggc

SEQ ID NO: 428 - DNA, 21 bp, Homo sapiens
tcgggcattgcgagggggata

SEQ ID NO: 429 - DNA, 21 bp, Homo sapiens
gggaagtaaggaccagagaca

SEQ ID NO: 430 - DNA, 21 bp, Homo sapiens
gtagccactgtctccatccac

SEQ ID NO: 431 - DNA, 21 bp, Homo sapiens
tgccgcccagttgacctgtgg

SEQ ID NO: 432 - DNA, 21 bp, Homo sapiens
aggttgtgttgcatccgcaac

SEQ ID NO: 433 - DNA, 21 bp, Homo sapiens
tgtgactgcttgtagatggcc

SEQ ID NO: 434 - DNA, 21 bp, Homo sapiens
catgaatggccgtaggcttca

SEQ ID NO: 435 - DNA, 21 bp, Homo sapiens
ccgacgatgagcccgagcctg

SEQ ID NO: 436 - DNA, 21 bp, Homo sapiens
gaaggagtttctgcagattga

SEQ ID NO: 437 - DNA, 21 bp, Homo sapiens
gtcaagaggggcagcaacacc

SEQ ID NO: 438 - DNA, 21 bp, Homo sapiens
atactttgtggaccacaatac

SEQ ID NO: 439 - DNA, 21 bp, Homo sapiens
gtagtcaaagcgcagcggggg

SEQ ID NO: 440 - DNA, 21 bp, Homo sapiens
ctgcacactcgtggtccagac

SEQ ID NO: 441 - DNA, 21 bp, Homo sapiens
ctttcctgtagactgctctct

SEQ ID NO: 442 - DNA, 21 bp, Homo sapiens
acatcaagattcagtgtcaaa

SEQ ID NO: 443 - DNA, 21 bp, Homo sapiens
tcacctcacggctacctatct

SEQ ID NO: 444 - DNA, 21 bp, Homo sapiens
cagggacattccacggtagaa

SEQ ID NO: 445 - DNA, 21 bp, Homo sapiens
catgcaaaatttgttttttct

SEQ ID NO: 446 - DNA, 21 bp, Homo sapiens
tattccatggcttcacagaca

SEQ ID NO: 447 - DNA, 22 bp, Homo sapiens
aacttgccacaacagccacaac

SEQ ID NO: 448 - DNA, 21 bp, Homo sapiens
tcagacgtggccctccaccat

SEQ ID NO: 449 - DNA, 21 bp, Homo sapiens
agagacctacacattgggatt

SEQ ID NO: 450 - DNA, 21 bp, Homo sapiens
ttctggagaactgattaggga

SEQ ID NO: 451 - DNA, 21 bp, Homo sapiens
tcctccaggcagctgacagct

SEQ ID NO: 452 - DNA, 21 bp, Homo sapiens
ccgactatgggctggagagct

SEQ ID NO: 453 - DNA, 21 bp, Homo sapiens
cccgacgatgagcccgagcct

SEQ ID NO: 454 - DNA, 21 bp, Homo sapiens
tatgggcgtcgtcttcttata

SEQ ID NO: 455 - DNA, 21 bp, Homo sapiens
tgctgttgctttggggtgctc

SEQ ID NO: 456 - DNA, 21 bp, Homo sapiens
gtatatcctgcggtcccgctc

SEQ ID NO: 457 - DNA, 21 bp, Homo sapiens
aattccaaaagctgcaatata

SEQ ID NO: 458 - DNA, 21 bp, Homo sapiens
tttttaaagtctgagaaacag

SEQ ID NO: 459 - DNA, 21 bp, Homo sapiens
tttggtgttagatttgtcatt

SEQ ID NO: 460 - DNA, 21 bp, Homo sapiens
gagctggcagcgctgttggct

SEQ ID NO: 461 - DNA, 21 bp, Homo sapiens
tcatttcaccagggcagccat

SEQ ID NO: 462 - DNA, 21 bp, Homo sapiens
tttcaccagggcagccatggg

SEQ ID NO: 463 - DNA, 21 bp, Homo sapiens
tgctgcccctcagtcttcttt

SEQ ID NO: 464 - DNA, 21 bp, Homo sapiens
tcccacacacgggtctgtggt

SEQ ID NO: 465 - DNA, 21 bp, Homo sapiens
ttattaactttgaactccttc

SEQ ID NO: 466 - DNA, 22 bp, Homo sapiens
ggatcggcggcagcagctgcag

SEQ ID NO: 467 - DNA, 21 bp, Homo sapiens
gttaggctgcagaacaagcaa

SEQ ID NO: 468 - DNA, 21 bp, Homo sapiens
ctctacggccgtctcgccgga

SEQ ID NO: 469 - DNA, 21 bp, Homo sapiens
tgaatggaagtttatcagaag

SEQ ID NO: 470 - DNA, 22 bp, Homo sapiens
ctagtggctgctggagaagttg

SEQ ID NO: 471 - DNA, 21 bp, Homo sapiens
gttgaggcccggtgatgagtc

SEQ ID NO: 472 - DNA, 21 bp, Homo sapiens
aacaaaccagttttcattgtc

SEQ ID NO: 473 - DNA, 21 bp, Homo sapiens
ggtttctcatcaatgtgagat

SEQ ID NO: 474 - DNA, 21 bp, Homo sapiens
acagatggtacagctcatttt

SEQ ID NO: 475 - DNA, 21 bp, Homo sapiens
tatttcagtaggtaagtgaag

SEQ ID NO: 476 - DNA, 21 bp, Homo sapiens
ccatgcatgtccccatgacca

SEQ ID NO: 477 - DNA, 21 bp, Homo sapiens
tgggcaaagcggagccaaaat

SEQ ID NO: 478 - DNA, 21 bp, Homo sapiens
gtcttgctggggcagaccacg

SEQ ID NO: 479 - DNA, 21 bp, Homo sapiens
gaaactattccaatgttcagt

SEQ ID NO: 480 - DNA, 21 bp, Homo sapiens
ccccttggtcgtccccagaca

SEQ ID NO: 481 - DNA, 21 bp, Homo sapiens
tcgatgtagtgattaatggct

SEQ ID NO: 482 - DNA, 21 bp, Homo sapiens
cgaagacgacgacgagccgga

SEQ ID NO: 483 - DNA, 21 bp, Homo sapiens
cctgctaaaatgatagaggca

SEQ ID NO: 484 - DNA, 21 bp, Homo sapiens
ggccgcatctccgcacactct

SEQ ID NO: 485 - DNA, 21 bp, Homo sapiens
ttaggaaatcctttcggctct

SEQ ID NO: 486 - DNA, 21 bp, Homo sapiens
gattcttgtttttaagatctt

SEQ ID NO: 487 - DNA, 21 bp, Homo sapiens
aagcctacaaatatatcactg

SEQ ID NO: 488 - DNA, 21 bp, Homo sapiens
tcaccctccccgcccccggcg

SEQ ID NO: 489 - DNA, 21 bp, Homo sapiens
cccggacagccgtgtaatagg

SEQ ID NO: 490 - DNA, 21 bp, Homo sapiens
cagcaacgtcacctccttctt

SEQ ID NO: 491 - DNA, 21 bp, Homo sapiens
acacagtggtcaagcgagtgg

SEQ ID NO: 492 - DNA, 21 bp, Homo sapiens
ggggcagggccgcgcccagca

SEQ ID NO: 493 - DNA, 21 bp, Homo sapiens
gtctattctacagtaagtgac

SEQ ID NO: 494 - DNA, 21 bp, Homo sapiens
attgattatgccttctgggta

SEQ ID NO: 495 - DNA, 21 bp, Homo sapiens
gaagtttaggatggcttcagc

SEQ ID NO: 496 - DNA, 22 bp, Homo sapiens
ggcagggagaggaagccgatag

SEQ ID NO: 497 - DNA, 21 bp, Homo sapiens
gtgagtagtacgatatataac

SEQ ID NO: 498 - DNA, 21 bp, Homo sapiens
tagtgactggcgcatgttcag

SEQ ID NO: 499 - DNA, 21 bp, Homo sapiens
accatgggcacgcactcaata

SEQ ID NO: 500 - DNA, 21 bp, Homo sapiens
tcatcctgggcggggtggaac

SEQ ID NO: 501 - DNA, 21 bp, Homo sapiens
ttcctgcacaagattattgcg

SEQ ID NO: 502 - DNA, 21 bp, Homo sapiens
gcctacgccaccagctccaac

SEQ ID NO: 503 - DNA, 21 bp, Homo sapiens
ctccttccgtgtgcagctcat

SEQ ID NO: 504 - DNA, 21 bp, Homo sapiens
gtgaccgatatcgagtgtgtt

SEQ ID NO: 505 - DNA, 21 bp, Homo sapiens
catagtatgcgctgtcgaaat

SEQ ID NO: 506 - DNA, 21 bp, Homo sapiens
ccctctctgtgtggactgtcc

SEQ ID NO: 507 - DNA, 21 bp, Homo sapiens
acccgacgatgagcccgagcc

SEQ ID NO: 508 - DNA, 21 bp, Homo sapiens
attacaacaggtaaatcttta

SEQ ID NO: 509 - DNA, 21 bp, Homo sapiens
tactttgtggaccacaatacc

SEQ ID NO: 510 - DNA, 21 bp, Homo sapiens
cccggtgccacgtggtgttcc

SEQ ID NO: 511 - DNA, 21 bp, Homo sapiens
tgtgtacggcgccacaatcaa

SEQ ID NO: 512 - DNA, 21 bp, Homo sapiens
atcccttattcgacatcagat

SEQ ID NO: 513 - DNA, 21 bp, Homo sapiens
gattgaacaaatgcagcccac

SEQ ID NO: 514 - DNA, 21 bp, Homo sapiens
agagcttgcactgaatagaag

SEQ ID NO: 515 - DNA, 21 bp, Homo sapiens
ttgatgggctccctctaccct

SEQ ID NO: 516 - DNA, 21 bp, Homo sapiens
caagttcaaggagtttgtcca

SEQ ID NO: 517 - DNA, 21 bp, Homo sapiens
actttctgatccagtggaaac

SEQ ID NO: 518 - DNA, 21 bp, Homo sapiens
ctttggtgttagatttgtcat

SEQ ID NO: 519 - DNA, 21 bp, Homo sapiens
cctctcactaagcaggctaga

SEQ ID NO: 520 - DNA, 21 bp, Homo sapiens
tctaggcgcacgtctccttca

SEQ ID NO: 521 - DNA, 21 bp, Homo sapiens
actacacgtcggtggagacgc

SEQ ID NO: 522 - DNA, 21 bp, Homo sapiens
ggcaccaccacactatgtcga

SEQ ID NO: 523 - DNA, 21 bp, Homo sapiens
ggatggcattgggggcctgag

SEQ ID NO: 524 - DNA, 22 bp, Homo sapiens
gaggcggcgcggcagccgctgg

SEQ ID NO: 525 - DNA, 21 bp, Homo sapiens
aggacccacacgacgggaaga

SEQ ID NO: 526 - DNA, 21 bp, Homo sapiens
accaccttctcagacagctct

SEQ ID NO: 527 - DNA, 21 bp, Homo sapiens
accaagggccggccgttgacc

SEQ ID NO: 528 - DNA, 21 bp, Homo sapiens
ttgatgatgatttcagtcttg

SEQ ID NO: 529 - DNA, 21 bp, Homo sapiens
tctccgcctccggacagtcgg

SEQ ID NO: 530 - DNA, 21 bp, Homo sapiens
cagagatgtcccggttctccg

SEQ ID NO: 531 - DNA, 23 bp, Homo sapiens
cagaggctggtctggcagcaagc

SEQ ID NO: 532 - DNA, 21 bp, Homo sapiens
aagcagacccagaccacctct

SEQ ID NO: 533 - DNA, 21 bp, Homo sapiens
aaacagtttttctggacaaac

SEQ ID NO: 534 - DNA, 21 bp, Homo sapiens
attagtgaaagtatagaaatg

SEQ ID NO: 535 - DNA, 21 bp, Homo sapiens
cttcgtgtccgctttcctgtt

SEQ ID NO: 536 - DNA, 21 bp, Homo sapiens
gatgttgtccgacagtccatt

SEQ ID NO: 537 - DNA, 21 bp, Homo sapiens
cggctggcccgcagcccacgt

SEQ ID NO: 538 - DNA, 21 bp, Homo sapiens
ggaaacaccatcatccttgct

SEQ ID NO: 539 - DNA, 21 bp, Homo sapiens
gaaaggacttgacaggtgtga

SEQ ID NO: 540 - DNA, 21 bp, Homo sapiens
atgtggcaaggtttttaatca

SEQ ID NO: 541 - DNA, 21 bp, Homo sapiens
cagtggcgctaagccgtgcca

SEQ ID NO: 542 - DNA, 21 bp, Homo sapiens
ccagctactacgtgtcttatc

SEQ ID NO: 543 - DNA, 21 bp, Homo sapiens
agaacctcaaacccaaggaga

SEQ ID NO: 544 - DNA, 21 bp, Homo sapiens
ttggcagtggctaccagacct

SEQ ID NO: 545 - DNA, 21 bp, Homo sapiens
acttggctgcggcaactttgg

SEQ ID NO: 546 - DNA, 22 bp, Homo sapiens
gcctcagcccagccgccatatg

SEQ ID NO: 547 - DNA, 21 bp, Homo sapiens
ctcctccaggcagctgacagc

SEQ ID NO: 548 - DNA, 21 bp, Homo sapiens
ttggagggagagggggtgact

SEQ ID NO: 549 - DNA, 21 bp, Homo sapiens
aaaacctgaatactattatcc

SEQ ID NO: 550 - DNA, 21 bp, Homo sapiens
cggcgaatgcgttgtgctact

SEQ ID NO: 551 - DNA, 21 bp, Homo sapiens
tcaagaggggcagcaacacca

SEQ ID NO: 552 - DNA, 21 bp, Homo sapiens
ccccgactgcgggaagacctt

SEQ ID NO: 553 - DNA, 21 bp, Homo sapiens
gccccgactgcgggaagacct

SEQ ID NO: 554 - DNA, 21 bp, Homo sapiens
tgacccgttgccagagtgcag

SEQ ID NO: 555 - DNA, 21 bp, Homo sapiens
atctatcaccgtccccaagtt

SEQ ID NO: 556 - DNA, 21 bp, Homo sapiens
ggtgctgttgctttggggtgc

SEQ ID NO: 557 - DNA, 21 bp, Homo sapiens
agttcacatcctggagatgta

SEQ ID NO: 558 - DNA, 21 bp, Homo sapiens
gatccagtttgtcgattcaaa

SEQ ID NO: 559 - DNA, 21 bp, Homo sapiens
cacctcaggtattacaggtat

SEQ ID NO: 560 - DNA, 21 bp, Homo sapiens
attcttgtttttaagatcttc

SEQ ID NO: 561 - DNA, 21 bp, Homo sapiens
taagaaaaccgagaaatcaaa

SEQ ID NO: 562 - DNA, 21 bp, Homo sapiens
ccgacatcaatgcagtggctg

SEQ ID NO: 563 - DNA, 21 bp, Homo sapiens
gcaggcggcgcgcgcatcccg

SEQ ID NO: 564 - DNA, 21 bp, Homo sapiens
aaaaattcaattcatttcacc

SEQ ID NO: 565 - DNA, 21 bp, Homo sapiens
gggcttccataaagattcagg

SEQ ID NO: 566 - DNA, 21 bp, Homo sapiens
ttgtttgtagcgatacaaact

SEQ ID NO: 567 - DNA, 21 bp, Homo sapiens
tgtcattacccctaaaatgct

SEQ ID NO: 568 - DNA, 21 bp, Homo sapiens
cgcctcagagctgccagcacc

SEQ ID NO: 569 - DNA, 21 bp, Homo sapiens
agcttccgctcgatctctgcc

SEQ ID NO: 570 - DNA, 21 bp, Homo sapiens
cgacttggacgtggtgttcac

SEQ ID NO: 571 - DNA, 21 bp, Homo sapiens
gtcccatgaggtaaggcctcc

SEQ ID NO: 572 - DNA, 21 bp, Homo sapiens
ctaacagcttctttgaagtct

SEQ ID NO: 573 - DNA, 21 bp, Homo sapiens
tgtctccattataaatagaaa

SEQ ID NO: 574 - DNA, 21 bp, Homo sapiens
atgaagttctttgcttcttct

SEQ ID NO: 575 - DNA, 21 bp, Homo sapiens
cctttgtctagaggagaggga

SEQ ID NO: 576 - DNA, 21 bp, Homo sapiens
ggtttgtctgcagtatgaagc

SEQ ID NO: 577 - DNA, 21 bp, Homo sapiens
ttgggccagttggaacgggag

SEQ ID NO: 578 - DNA, 21 bp, Homo sapiens
tgctatgtgcgtttgctgtcc

SEQ ID NO: 579 - DNA, 21 bp, Homo sapiens
ggtggtctacccaacccaaga

SEQ ID NO: 580 - DNA, 21 bp, Homo sapiens
cctgcagctgctgcttgacgt

SEQ ID NO: 581 - DNA, 21 bp, Homo sapiens
agcttgtgtgtcaatatctcg

SEQ ID NO: 582 - DNA, 21 bp, Homo sapiens
agcttcatgatctccaggtga

SEQ ID NO: 583 - DNA, 21 bp, Homo sapiens
attcactggtggatggccttc

SEQ ID NO: 584 - DNA, 22 bp, Homo sapiens
actatggctactacagcagata

SEQ ID NO: 585 - DNA, 21 bp, Homo sapiens
ccaattctctataaagtgggt

SEQ ID NO: 586 - DNA, 21 bp, Homo sapiens
gctctttgtcagtcctttctt

SEQ ID NO: 587 - DNA, 23 bp, Homo sapiens
tgtccatgggttcttcatcaggc

SEQ ID NO: 588 - DNA, 21 bp, Homo sapiens
aagagaatcatgttcatggta

SEQ ID NO: 589 - DNA, 21 bp, Homo sapiens
gtgaccgatatcgagtgtgtt

SEQ ID NO: 590 - DNA, 21 bp, Homo sapiens
gaccagtctgcgactgtgctg

SEQ ID NO: 591 - DNA, 21 bp, Homo sapiens
catgccatctcggtggcagcg

SEQ ID NO: 592 - DNA, 21 bp, Homo sapiens
atctccttacggagctccccg

SEQ ID NO: 593 - DNA, 21 bp, Homo sapiens
tacattgtgcggactgagcac

SEQ ID NO: 594 - DNA, 21 bp, Homo sapiens
agttcagctacgggagagggg

SEQ ID NO: 595 - DNA, 21 bp, Homo sapiens
ctgtaatgtcgatattcatgt

SEQ ID NO: 596 - DNA, 21 bp, Homo sapiens
cataggctgtcgaccacagct

SEQ ID NO: 597 - DNA, 21 bp, Homo sapiens
tcctgctaaaatgatagaggc

SEQ ID NO: 598 - DNA, 21 bp, Homo sapiens
agagataaagccatttatgaa

SEQ ID NO: 599 - DNA, 21 bp, Homo sapiens
tagattgtgctgcttggcacc

SEQ ID NO: 600 - DNA, 21 bp, Homo sapiens
gatggtgcaacgtcggaacac

SEQ ID NO: 601 - DNA, 21 bp, Homo sapiens
gcgatggcgtaggagacggcc

SEQ ID NO: 602 - DNA, 21 bp, Homo sapiens
aaaggtgaggcggaacttgtt

SEQ ID NO: 603 - DNA, 21 bp, Homo sapiens
aaggagtttctgcagattgac

SEQ ID NO: 604 - DNA, 21 bp, Homo sapiens
gccagcggggtgaccctcaga

SEQ ID NO: 605 - DNA, 21 bp, Homo sapiens
tcagatgccacaccagggggt

SEQ ID NO: 606 - DNA, 21 bp, Homo sapiens
cttttccagcgttttacaggg

SEQ ID NO: 607 - DNA, 21 bp, Homo sapiens
ggtcttctacgtcttgtcctt

SEQ ID NO: 608 - DNA, 21 bp, Homo sapiens
cgacatcaatgcagtggctgt

SEQ ID NO: 609 - DNA, 21 bp, Homo sapiens
agtagtacagcagctgcccag

SEQ ID NO: 610 - DNA, 21 bp, Homo sapiens
gtagtacagcagctgcccagc

SEQ ID NO: 611 - DNA, 21 bp, Homo sapiens
tcatcttcaaccacaggtata

SEQ ID NO: 612 - DNA, 21 bp, Homo sapiens
tatacaaagacgatatcttta

SEQ ID NO: 613 - DNA, 21 bp, Homo sapiens
ctcttgggtcgttgctttgtg

SEQ ID NO: 614 - DNA, 21 bp, Homo sapiens
ggacgcgggcgcacaggtctt

SEQ ID NO: 615 - DNA, 21 bp, Homo sapiens
ataaaataaaaggcaacacca

SEQ ID NO: 616 - DNA, 21 bp, Homo sapiens
cctctgcagactattccaccc

SEQ ID NO: 617 - DNA, 21 bp, Homo sapiens
aggcacagatgtcccgtccag

SEQ ID NO: 618 - DNA, 21 bp, Homo sapiens
aatctttgtaccagtctggag

SEQ ID NO: 619 - DNA, 21 bp, Homo sapiens
gatgaagcctacaaatatatc

SEQ ID NO: 620 - DNA, 21 bp, Homo sapiens
aagcctacaaatatatcactg

SEQ ID NO: 621 - DNA, 21 bp, Homo sapiens
ttgctgcaccgcctcctgctg

SEQ ID NO: 622 - DNA, 21 bp, Homo sapiens
gtgctcggcccttctataggt

SEQ ID NO: 623 - DNA, 21 bp, Homo sapiens
atggctaaccgccattatggc

SEQ ID NO: 624 - DNA, 21 bp, Homo sapiens
gctgcttgagtaactgtctcg

SEQ ID NO: 625 - DNA, 21 bp, Homo sapiens
aagtgcctgccccacctggtg

SEQ ID NO: 626 - DNA, 20 bp, Homo sapiens
ttttatggcaggagaaacag

SEQ ID NO: 627 - DNA, 21 bp, Homo sapiens
cagcaggaacttttcgttgct

SEQ ID NO: 628 - DNA, 21 bp, Homo sapiens
ccttgcttctgatactgacaa

SEQ ID NO: 629 - DNA, 21 bp, Homo sapiens
gatgggtggcgtgccaaggcc

SEQ ID NO: 630 - DNA, 21 bp, Homo sapiens
gatgatcgtcgtggtggcaga

SEQ ID NO: 631 - DNA, 21 bp, Homo sapiens
cgcagctgccaggggggacct

SEQ ID NO: 632 - DNA, 21 bp, Homo sapiens
acctcctgccccatctccttc

SEQ ID NO: 633 - DNA, 21 bp, Homo sapiens
agtatagaagaatgtgcagca

SEQ ID NO: 634 - DNA, 21 bp, Homo sapiens
cacttggacagtcatagtgac

SEQ ID NO: 635 - DNA, 21 bp, Homo sapiens
cccacgtcttagaaccttcac

SEQ ID NO: 636 - DNA, 21 bp, Homo sapiens
atctctcggacgccacgttgg

SEQ ID NO: 637 - DNA, 21 bp, Homo sapiens
tgattgcaccaattcacctta

SEQ ID NO: 638 - DNA, 21 bp, Homo sapiens
ccttcttcgccgccgtcagga

SEQ ID NO: 639 - DNA, 21 bp, Homo sapiens
gtgcgccggtctctcccagga

SEQ ID NO: 640 - DNA, 21 bp, Homo sapiens
ctcatcgacttctgcgatacc

SEQ ID NO: 641 - DNA, 21 bp, Homo sapiens
ggatgtatcagataatatgca

SEQ ID NO: 642 - DNA, 21 bp, Homo sapiens
gtgcggggcataactccagcc

SEQ ID NO: 643 - DNA, 21 bp, Homo sapiens
ccggcgtaaggctgtctccac

SEQ ID NO: 644 - DNA, 21 bp, Homo sapiens
ttccagtgtgatgatggtgag

SEQ ID NO: 645 - DNA, 21 bp, Homo sapiens
acaacctcaaagacttcttag

SEQ ID NO: 646 - DNA, 21 bp, Homo sapiens
caccctaactgccatgagtgt

SEQ ID NO: 647 - DNA, 21 bp, Homo sapiens
agatccagtgccctacctgcc

SEQ ID NO: 648 - DNA, 21 bp, Homo sapiens
tccttcagggcgccatatggt

SEQ ID NO: 649 - DNA, 21 bp, Homo sapiens
tgctagacactaaagggaaaa

SEQ ID NO: 650 - DNA, 21 bp, Homo sapiens
tacttactgcgtctgtgataa

SEQ ID NO: 651 - DNA, 21 bp, Homo sapiens
acggccggcactttgtgctgg

SEQ ID NO: 652 - DNA, 21 bp, Homo sapiens
catgtagatgctgggatagag

SEQ ID NO: 653 - DNA, 21 bp, Homo sapiens
atacttactgataaacttgtt

SEQ ID NO: 654 - DNA, 21 bp, Homo sapiens
aaacctgaatactattatcct

SEQ ID NO: 655 - DNA, 21 bp, Homo sapiens
ttcctgctaaaatgatagagg

SEQ ID NO: 656 - DNA, 21 bp, Homo sapiens
ctccgaggcgatgcactgtcg

SEQ ID NO: 657 - DNA, 21 bp, Homo sapiens
atttcttctgcgatgtcccag

SEQ ID NO: 658 - DNA, 21 bp, Homo sapiens
aagaggggcagcaacaccacc

SEQ ID NO: 659 - DNA, 21 bp, Homo sapiens
atcttgtctgcgcccagtgcc

SEQ ID NO: 660 - DNA, 21 bp, Homo sapiens
cttgtacattgtctttagagt

SEQ ID NO: 661 - DNA, 21 bp, Homo sapiens
taggaaatcctttcggctctc

SEQ ID NO: 662 - DNA, 21 bp, Homo sapiens
ggcaccatcacggtgaggtat

SEQ ID NO: 663 - DNA, 21 bp, Homo sapiens
cctgctgccagacggcctgtg

SEQ ID NO: 664 - DNA, 21 bp, Homo sapiens
ttgctgcctcggtcctgggtc

SEQ ID NO: 665 - DNA, 21 bp, Homo sapiens
ataacattgcttatattcctg

SEQ ID NO: 666 - DNA, 21 bp, Homo sapiens
ctctgcatatgcaggatgagt

SEQ ID NO: 667 - DNA, 21 bp, Homo sapiens
aggatcttggcgtaggatgag

SEQ ID NO: 668 - DNA, 21 bp, Homo sapiens
gatgaagcctacaaatatatc

SEQ ID NO: 669 - DNA, 21 bp, Homo sapiens
aactgagtttccagcagctac

SEQ ID NO: 670 - DNA, 21 bp, Homo sapiens
ggtgaagagtcaaaaaccagt

SEQ ID NO: 671 - DNA, 21 bp, Homo sapiens
gtccttgattccgtgctggtt

SEQ ID NO: 672 - DNA, 21 bp, Homo sapiens
agcccccgcagggccccagct

SEQ ID NO: 673 - DNA, 21 bp, Homo sapiens
acatcctcctccacactggac

SEQ ID NO: 674 - DNA, 21 bp, Homo sapiens
caggggagtactgtaggaaga

SEQ ID NO: 675 - DNA, 21 bp, Homo sapiens
tcctacctccgagtcacgctc

SEQ ID NO: 676 - DNA, 21 bp, Homo sapiens
atcacctacatgttgagtgta

SEQ ID NO: 677 - DNA, 21 bp, Homo sapiens
ccaatgcctgcttcgagccag

SEQ ID NO: 678 - DNA, 21 bp, Homo sapiens
ttgtccaccgttgtcccatgc

SEQ ID NO: 679 - DNA, 21 bp, Homo sapiens
gaggatgggcctccggttcat

SEQ ID NO: 680 - DNA, 21 bp, Homo sapiens
gtggccaggcgctcctgagca

SEQ ID NO: 681 - DNA, 21 bp, Homo sapiens
gtggagaaatttgtgagacat

SEQ ID NO: 682 - DNA, 21 bp, Homo sapiens
catggagcacgtaaccctttt

SEQ ID NO: 683 - DNA, 21 bp, Homo sapiens
actgtcaaagtgaggactggt

SEQ ID NO: 684 - DNA, 21 bp, Homo sapiens
ttccaggatcacatctctgta

SEQ ID NO: 685 - DNA, 21 bp, Homo sapiens
ggcaccaccacactatgtcga

SEQ ID NO: 686 - DNA, 21 bp, Homo sapiens
atctgccggagctgcagcgcg

SEQ ID NO: 687 - DNA, 21 bp, Homo sapiens
ggtttggaccgtgtattctcc

SEQ ID NO: 688 - DNA, 23 bp, Homo sapiens
agcggattgttgatgaagttttt

SEQ ID NO: 689 - DNA, 21 bp, Homo sapiens
gcagcagccctggaggtaaag

SEQ ID NO: 690 - DNA, 21 bp, Homo sapiens
tgtcctcgtaccctaaaagcc

SEQ ID NO: 691 - DNA, 21 bp, Homo sapiens
aaaggaaagcgctaacttcca

SEQ ID NO: 692 - DNA, 21 bp, Homo sapiens
ggttcttctcggagaaggtct

SEQ ID NO: 693 - DNA, 21 bp, Homo sapiens
ctcttggcggcgcagcggctg

SEQ ID NO: 694 - DNA, 21 bp, Homo sapiens
gctctgtggcgtgggcatgca

SEQ ID NO: 695 - DNA, 21 bp, Homo sapiens
tctgtcttgccgctctcgcct

SEQ ID NO: 696 - DNA, 21 bp, Homo sapiens
agagcctgggctgttcttgca

SEQ ID NO: 697 - DNA, 21 bp, Homo sapiens
atgtgatgctgatccttcagc

SEQ ID NO: 698 - DNA, 21 bp, Homo sapiens
cagcacctaccggagctgttc

SEQ ID NO: 699 - DNA, 21 bp, Homo sapiens
cacctcctttcgacctggcct

SEQ ID NO: 700 - DNA, 21 bp, Homo sapiens
gaagtctttcatcagagttat

SEQ ID NO: 701 - DNA, 23 bp, Homo sapiens
ggagtggctgcttggggcaaggg

SEQ ID NO: 702 - DNA, 21 bp, Homo sapiens
tctgtgcgccggtctctccca

SEQ ID NO: 703 - DNA, 21 bp, Homo sapiens
gtccgtttatgttgaagctca

SEQ ID NO: 704 - DNA, 21 bp, Homo sapiens
aaccccatggcaagaatgatg

SEQ ID NO: 705 - DNA, 22 bp, Homo sapiens
ctagtggctgctggagaagttg

SEQ ID NO: 706 - DNA, 21 bp, Homo sapiens
gctactgatgcgagccacttc

SEQ ID NO: 707 - DNA, 21 bp, Homo sapiens
ctggcgtacagcgtgtccatg

SEQ ID NO: 708 - DNA, 21 bp, Homo sapiens
tgtccaacttcggtggccagc

SEQ ID NO: 709 - DNA, 21 bp, Homo sapiens
ttttgagttgcactccacctg

SEQ ID NO: 710 - DNA, 21 bp, Homo sapiens
tattgaaaagtatgtagacca

SEQ ID NO: 711 - DNA, 21 bp, Homo sapiens
gaccagggacgtggctgtgga

SEQ ID NO: 712 - DNA, 21 bp, Homo sapiens
atgttggacacggcggggagg

SEQ ID NO: 713 - DNA, 21 bp, Homo sapiens
ctacgtaactgatttaattgt

SEQ ID NO: 714 - DNA, 21 bp, Homo sapiens
acttccattgcccatgaaaaa

SEQ ID NO: 715 - DNA, 23 bp, Homo sapiens
tatcggcaggtatgtgtgtgttg

SEQ ID NO: 716 - DNA, 21 bp, Homo sapiens
ctttggtcctaccatgttcct

SEQ ID NO: 717 - DNA, 21 bp, Homo sapiens
gaccagcagcgccaaggcatt

SEQ ID NO: 718 - DNA, 21 bp, Homo sapiens
acttcctgatgacagtgaaga

SEQ ID NO: 719 - DNA, 21 bp, Homo sapiens
agatgttgctgccagatgtaa

SEQ ID NO: 720 - DNA, 21 bp, Homo sapiens
ggctggccctgcgcccccctg

SEQ ID NO: 721 - DNA, 21 bp, Homo sapiens
tctccgaggcgatgcactgtc

SEQ ID NO: 722 - DNA, 21 bp, Homo sapiens
tccgaggcgatgcactgtcga

SEQ ID NO: 723 - DNA, 21 bp, Homo sapiens
acttgcgcttctcagccttca

SEQ ID NO: 724 - DNA, 21 bp, Homo sapiens
aggagtttctgcagattgact

SEQ ID NO: 725 - DNA, 21 bp, Homo sapiens
aagctgatgggtgctgattct

SEQ ID NO: 726 - DNA, 21 bp, Homo sapiens
atggccgcatctccgcacact

SEQ ID NO: 727 - DNA, 21 bp, Homo sapiens
attgcaaagagaatcacaaga

SEQ ID NO: 728 - DNA, 21 bp, Homo sapiens
gggctttcttcggctgaagga

SEQ ID NO: 729 - DNA, 21 bp, Homo sapiens
atgtctgtaattgttcgaact

SEQ ID NO: 730 - DNA, 21 bp, Homo sapiens
tgaaggacacgaagctgctct

SEQ ID NO: 731 - DNA, 21 bp, Homo sapiens
ttcagcaccacgtatgtactt

SEQ ID NO: 732 - DNA, 21 bp, Homo sapiens
attccaaaagctgcaatataa

SEQ ID NO: 733 - DNA, 21 bp, Homo sapiens
tgctttggtgttagatttgtc

SEQ ID NO: 734 - DNA, 21 bp, Homo sapiens
tctcgtccctccacggcgtat

SEQ ID NO: 735 - DNA, 21 bp, Homo sapiens
agagtagtacagcagctgccc

SEQ ID NO: 736 - DNA, 21 bp, Homo sapiens
ctggggtaccagtaaggtgag

SEQ ID NO: 737 - DNA, 21 bp, Homo sapiens
gttggcctgacgccattgtca

SEQ ID NO: 738 - DNA, 21 bp, Homo sapiens
cagtggtggccgcatcaaaat

SEQ ID NO: 739 - DNA, 21 bp, Homo sapiens
aaaattctcccgcagagattc

SEQ ID NO: 740 - DNA, 21 bp, Homo sapiens
cgtgcccctgccgccacccat

SEQ ID NO: 741 - DNA, 21 bp, Homo sapiens
aattgtagtcgttgaaaaaac

SEQ ID NO: 742 - DNA, 21 bp, Homo sapiens
tctctccttttctttatcatt

SEQ ID NO: 743 - DNA, 21 bp, Homo sapiens
actcactgtggttgccaatgg

SEQ ID NO: 744 - DNA, 21 bp, Homo sapiens
ttgcactttttggatactttg

SEQ ID NO: 745 - DNA, 21 bp, Homo sapiens
ggtacacatcgttgtacagat

SEQ ID NO: 746 - DNA, 21 bp, Homo sapiens
atgctgttggcggcctggatt

SEQ ID NO: 747 - DNA, 21 bp, Homo sapiens
cggtccacagcgggcttcaca

SEQ ID NO: 748 - DNA, 21 bp, Homo sapiens
cgtactctttggggtggtcag

SEQ ID NO: 749 - DNA, 21 bp, Homo sapiens
caaccgaaggcgactgtgggc

SEQ ID NO: 750 - DNA, 21 bp, Homo sapiens
ggaccgtggcgggccccgtgg

SEQ ID NO: 751 - DNA, 21 bp, Homo sapiens
ctccgcttacttgtaatctgc

SEQ ID NO: 752 - DNA, 21 bp, Homo sapiens
aggcgcgcttcgtcctcactg

SEQ ID NO: 753 - DNA, 21 bp, Homo sapiens
caatgtggtcgtctgtctggc

SEQ ID NO: 754 - DNA, 21 bp, Homo sapiens
gttctgtcccgctctccggat

SEQ ID NO: 755 - DNA, 21 bp, Homo sapiens
caatgcagttaactagtacaa

SEQ ID NO: 756 - DNA, 21 bp, Homo sapiens
ctgatagggaatcccttctac

SEQ ID NO: 757 - DNA, 21 bp, Homo sapiens
ctctcctggcgtgacgccatc

SEQ ID NO: 758 - DNA, 21 bp, Homo sapiens
ccgccttcgacgcacaatgct

SEQ ID NO: 759 - DNA, 21 bp, Homo sapiens
ccctaagcccagaagagcgag

SEQ ID NO: 760 - DNA, 21 bp, Homo sapiens
attctggtcaacagtaacctg

SEQ ID NO: 761 - DNA, 21 bp, Homo sapiens
ggctaagttccgcatgtccca

SEQ ID NO: 762 - DNA, 21 bp, Homo sapiens
ttaatgtactccttggttttg

SEQ ID NO: 763 - DNA, 21 bp, Homo sapiens
tggacagcaacggcagcaccg

SEQ ID NO: 764 - DNA, 21 bp, Homo sapiens
gatgggcctccggttcatgcc

SEQ ID NO: 765 - DNA, 21 bp, Homo sapiens
tattgttgaggctcatgatgg

SEQ ID NO: 766 - DNA, 21 bp, Homo sapiens
gccacccaccgtttacttgct

SEQ ID NO: 767 - DNA, 21 bp, Homo sapiens
gggccagctgcgctgagagca

SEQ ID NO: 768 - DNA, 21 bp, Homo sapiens
agtatgttcctttcccaccgt

SEQ ID NO: 769 - DNA, 21 bp, Homo sapiens
tgtcagtttcattattctatg

SEQ ID NO: 770 - DNA, 21 bp, Homo sapiens
caggatgctgctccggcagaa

SEQ ID NO: 771 - DNA, 21 bp, Homo sapiens
ttgtgaagcggatggtaaggg

SEQ ID NO: 772 - DNA, 21 bp, Homo sapiens
gaaaaggcctaagactcgaat

SEQ ID NO: 773 - DNA, 21 bp, Homo sapiens
gaaagcggacgaacttgcaga

SEQ ID NO: 774 - DNA, 23 bp, Homo sapiens
tggctggcggagaggctgggctg

SEQ ID NO: 775 - DNA, 21 bp, Homo sapiens
aacgcacggcgatacaggaga

SEQ ID NO: 776 - DNA, 21 bp, Homo sapiens
tgagcctcttcgacatcatca

SEQ ID NO: 777 - DNA, 21 bp, Homo sapiens
gggatccacattttggaagga

SEQ ID NO: 778 - DNA, 21 bp, Homo sapiens
tattgttgaattccttttcaa

SEQ ID NO: 779 - DNA, 21 bp, Homo sapiens
ggggatccaagaatacctatc

SEQ ID NO: 780 - DNA, 21 bp, Homo sapiens
ggttacagtcgcaaatgaaag

SEQ ID NO: 781 - DNA, 21 bp, Homo sapiens
ttcgcagggtgactccaaaaa

SEQ ID NO: 782 - DNA, 21 bp, Homo sapiens
aatggatctacgaaaactaat

SEQ ID NO: 783 - DNA, 21 bp, Homo sapiens
tgaacatcagcagatgagaga

SEQ ID NO: 784 - DNA, 21 bp, Homo sapiens
gttgacaagtggctctggatg

SEQ ID NO: 785 - DNA, 21 bp, Homo sapiens
atgaggaaactagacttcccc

SEQ ID NO: 786 - DNA, 21 bp, Homo sapiens
attaatgttgagctacaaacc

SEQ ID NO: 787 - DNA, 21 bp, Homo sapiens
gaacgggtccgaatacttcgt

SEQ ID NO: 788 - DNA, 21 bp, Homo sapiens
cttgtccagcggatccagaca

SEQ ID NO: 789 - DNA, 21 bp, Homo sapiens
agccaatggcagtctcctcct

SEQ ID NO: 790 - DNA, 22 bp, Homo sapiens
tggcgttgatgcgcgtcaccat

SEQ ID NO: 791 - DNA, 21 bp, Homo sapiens
ctatgccaacgtcagttagct

SEQ ID NO: 792 - DNA, 21 bp, Homo sapiens
aaaacaatgcataaagaaaaa

SEQ ID NO: 793 - DNA, 21 bp, Homo sapiens
agagacaaagaccatctctta

SEQ ID NO: 794 - DNA, 21 bp, Homo sapiens
ggtgtcagggggcctcaggga

SEQ ID NO: 795 - DNA, 21 bp, Homo sapiens
cacccgacgatgagcccgagc

SEQ ID NO: 796 - DNA, 21 bp, Homo sapiens
ggtcctgggtcactgggcttg

SEQ ID NO: 797 - DNA, 21 bp, Homo sapiens
catgtttgccttctttgcaca

SEQ ID NO: 798 - DNA, 21 bp, Homo sapiens
tagcagcaagtccgcaggcct

SEQ ID NO: 799 - DNA, 21 bp, Homo sapiens
tatggccgcatctccgcacac

SEQ ID NO: 800 - DNA, 21 bp, Homo sapiens
ctacagggcacgggtgagggc

SEQ ID NO: 801 - DNA, 21 bp, Homo sapiens
cgtggccatccgtgtcctcct

SEQ ID NO: 802 - DNA, 21 bp, Homo sapiens
acaatggagcgttctgccagg

SEQ ID NO: 803 - DNA, 21 bp, Homo sapiens
agcagcccagcagggcttcca

SEQ ID NO: 804 - DNA, 21 bp, Homo sapiens
tggggcagacatgtcgggcag

SEQ ID NO: 805 - DNA, 21 bp, Homo sapiens
tggatgcagcgtccattctca

SEQ ID NO: 806 - DNA, 21 bp, Homo sapiens
ttaagacaatacagatggtga

SEQ ID NO: 807 - DNA, 21 bp, Homo sapiens
ctggcatggcgtcccagtaac

SEQ ID NO: 808 - DNA, 21 bp, Homo sapiens
agaaactgacgattcaaacca

SEQ ID NO: 809 - DNA, 21 bp, Homo sapiens
cggaaacggtccctggtgagc

SEQ ID NO: 810 - DNA, 21 bp, Homo sapiens
cctttcctgtagactgctctc

SEQ ID NO: 811 - DNA, 21 bp, Homo sapiens
tattgttccagggaaggagca

SEQ ID NO: 812 - DNA, 21 bp, Homo sapiens
gcgccagctgcgcacagtagt

SEQ ID NO: 813 - DNA, 21 bp, Homo sapiens
gacatcaatgcagtggctgtg

SEQ ID NO: 814 - DNA, 21 bp, Homo sapiens
tgggagatttataagatgaca

SEQ ID NO: 815 - DNA, 21 bp, Homo sapiens
ctgtgaacttgcccttttgtg

SEQ ID NO: 816 - DNA, 21 bp, Homo sapiens
cgggtggtccgggaggagtac

SEQ ID NO: 817 - DNA, 21 bp, Homo sapiens
ccagcttctcgtcgaccctga

SEQ ID NO: 818 - DNA, 21 bp, Homo sapiens
acatcaagtcgtcccccaagc

SEQ ID NO: 819 - DNA, 21 bp, Homo sapiens
ctgatagggaatcccttctac

SEQ ID NO: 820 - DNA, 21 bp, Homo sapiens
ggacgaactggtgtaatgata

SEQ ID NO: 821 - DNA, 21 bp, Homo sapiens
aagcctacaaatatatcactg

SEQ ID NO: 822 - DNA, 21 bp, Homo sapiens
tatgaccgcttcgtggccatt

SEQ ID NO: 823 - DNA, 21 bp, Homo sapiens
gaaatggattcgtgccagggt

SEQ ID NO: 824 - DNA, 21 bp, Homo sapiens
catagcattcgcctactccgt

SEQ ID NO: 825 - DNA, 21 bp, Homo sapiens
gacaagctgcggccctactac

SEQ ID NO: 826 - DNA, 21 bp, Homo sapiens
gacaaaaaatgcattttgttc

SEQ ID NO: 827 - DNA, 21 bp, Homo sapiens
agacgactacgttgaagttct

SEQ ID NO: 828 - DNA, 21 bp, Homo sapiens
agctgatcaccccccaggtaa

SEQ ID NO: 829 - DNA, 21 bp, Homo sapiens
gaggcattacgctggccacaa

SEQ ID NO: 830 - DNA, 20 bp, Homo sapiens
gaattatggcttggaaacag

SEQ ID NO: 831 - DNA, 21 bp, Homo sapiens
aatattatcttcatttataga

SEQ ID NO: 832 - DNA, 21 bp, Homo sapiens
ggtccttctcgctgagatcct

SEQ ID NO: 833 - DNA, 21 bp, Homo sapiens
gtctcattatctttaaaccac

SEQ ID NO: 834 - DNA, 21 bp, Homo sapiens
gagcacagccatagaagggta

SEQ ID NO: 835 - DNA, 21 bp, Homo sapiens
agtccccctcgggggttccgc

SEQ ID NO: 836 - DNA, 21 bp, Homo sapiens
ttgtcttctgcgaactgtgga

SEQ ID NO: 837 - DNA, 21 bp, Homo sapiens
aatgggcttagtattctggga

SEQ ID NO: 838 - DNA, 22 bp, Homo sapiens
ctagtggctgctggagaagttg

SEQ ID NO: 839 - DNA, 21 bp, Homo sapiens
gaataccatcgccccatcaga

SEQ ID NO: 840 - DNA, 21 bp, Homo sapiens
tgcattcaatgttctgacaac

SEQ ID NO: 841 - DNA, 21 bp, Homo sapiens
caggacacttttttagcatga

SEQ ID NO: 842 - DNA, 21 bp, Homo sapiens
atccctcggacggatgtgggc

SEQ ID NO: 843 - DNA, 21 bp, Homo sapiens
caccgtcacgcgcacacaggt

SEQ ID NO: 844 - DNA, 21 bp, Homo sapiens
ttggagatatcgaagtatggg

SEQ ID NO: 845 - DNA, 21 bp, Homo sapiens
tcgaatagatggcgttgatca

SEQ ID NO: 846 - DNA, 21 bp, Homo sapiens
agctacatgtgaccctggctt

SEQ ID NO: 847 - DNA, 21 bp, Homo sapiens
actggtatcacgaccctagaa

SEQ ID NO: 848 - DNA, 21 bp, Homo sapiens
tcagacagtcggttggcatcc

SEQ ID NO: 849 - DNA, 21 bp, Homo sapiens
tctgggttgcgacaagcattg

SEQ ID NO: 850 - DNA, 21 bp, Homo sapiens
ggatgataaggttgttcatgt

SEQ ID NO: 851 - DNA, 21 bp, Homo sapiens
tcgaaagtttggtcgaagtaa

SEQ ID NO: 852 - DNA, 21 bp, Homo sapiens
ccctgcacagtctgcccaagg

SEQ ID NO: 853 - DNA, 21 bp, Homo sapiens
cctctccagcgtctttgctct

SEQ ID NO: 854 - DNA, 21 bp, Homo sapiens
cctggcgtgacgccatcttga

SEQ ID NO: 855 - DNA, 21 bp, Homo sapiens
ctgaagcagacacctgacttt

SEQ ID NO: 856 - DNA, 21 bp, Homo sapiens
caacaggattcctgtggagcc

SEQ ID NO: 857 - DNA, 21 bp, Homo sapiens
gggggcaatggcggcttcctg

SEQ ID NO: 858 - DNA, 21 bp, Homo sapiens
tgtatttgggcgccaaaggta

SEQ ID NO: 859 - DNA, 21 bp, Homo sapiens
gccacgatggtggacatccat

SEQ ID NO: 860 - DNA, 21 bp, Homo sapiens
actccagtccctcttcttcct

SEQ ID NO: 861 - DNA, 23 bp, Homo sapiens
aacggctacctcgccagcctctg

SEQ ID NO: 862 - DNA, 21 bp, Homo sapiens
tccgccttggggcctttcagg

SEQ ID NO: 863 - DNA, 21 bp, Homo sapiens
aagagggggcgccacttcttc

SEQ ID NO: 864 - DNA, 21 bp, Homo sapiens
aggcgctgtcgcccaccacac

SEQ ID NO: 865 - DNA, 21 bp, Homo sapiens
ctgtcgagaggtgagccttgt

SEQ ID NO: 866 - DNA, 21 bp, Homo sapiens
ccaccagcagcgtgcactgca

SEQ ID NO: 867 - DNA, 21 bp, Homo sapiens
ctgtgtgaattctttgatgta

SEQ ID NO: 868 - DNA, 21 bp, Homo sapiens
aatggctgaacgccaagatga

SEQ ID NO: 869 - DNA, 21 bp, Homo sapiens
ccaaggggacccacagccccc

SEQ ID NO: 870 - DNA, 21 bp, Homo sapiens
cttattgctgcggaaatttag

SEQ ID NO: 871 - DNA, 21 bp, Homo sapiens
tatctcccaacttcccttctg

SEQ ID NO: 872 - DNA, 21 bp, Homo sapiens
aggccttcggcacctgcggct

SEQ ID NO: 873 - DNA, 21 bp, Homo sapiens
gcgccatcaggcagctgagcg

SEQ ID NO: 874 - DNA, 21 bp, Homo sapiens
ccttccactcggataagatgc

SEQ ID NO: 875 - DNA, 21 bp, Homo sapiens
tggtagaagcgtgcaggaagc

SEQ ID NO: 876 - DNA, 21 bp, Homo sapiens
acaccggaaacggtttggtga

SEQ ID NO: 877 - DNA, 21 bp, Homo sapiens
cctcaacccgcgacctccagc

SEQ ID NO: 878 - DNA, 21 bp, Homo sapiens
gcttccaggtaacgaagaatt

SEQ ID NO: 879 - DNA, 21 bp, Homo sapiens
ctggccaggcgaaggatgtgg

SEQ ID NO: 880 - DNA, 21 bp, Homo sapiens
atactggcggtaagtctactt

SEQ ID NO: 881 - DNA, 21 bp, Homo sapiens
gctggccctgcgcccccctgt

SEQ ID NO: 882 - DNA, 21 bp, Homo sapiens
taatgaattattactactaac

SEQ ID NO: 883 - DNA, 21 bp, Homo sapiens
ccgaggcgatgcactgtcgag

SEQ ID NO: 884 - DNA, 21 bp, Homo sapiens
atgctcctccggtttatgtgt

SEQ ID NO: 885 - DNA, 21 bp, Homo sapiens
gtgctgaatgtgagtagaatt

SEQ ID NO: 886 - DNA, 21 bp, Homo sapiens
gcataattgcgttgtcctgtt

SEQ ID NO: 887 - DNA, 21 bp, Homo sapiens
ctttgtggaccacaatacccg

SEQ ID NO: 888 - DNA, 21 bp, Homo sapiens
ctggccatgacgctggaccgc

SEQ ID NO: 889 - DNA, 21 bp, Homo sapiens
caaggtaacctgaaaataaat

SEQ ID NO: 890 - DNA, 21 bp, Homo sapiens
acctaccttctggatgtaacc

SEQ ID NO: 891 - DNA, 21 bp, Homo sapiens
tctgagcacaaactcagatcc

SEQ ID NO: 892 - DNA, 21 bp, Homo sapiens
cgttccagctctaactgttct

SEQ ID NO: 893 - DNA, 21 bp, Homo sapiens
tgaagtcaaactaccaagaaa

SEQ ID NO: 894 - DNA, 21 bp, Homo sapiens
aagtcaaactaccaagaaaca

SEQ ID NO: 895 - DNA, 21 bp, Homo sapiens
gaagtcaaactaccaagaaac

SEQ ID NO: 896 - DNA, 21 bp, Homo sapiens
ctcatctggcgcttgttgtag

SEQ ID NO: 897 - DNA, 21 bp, Homo sapiens
tggacctcgcgcagctcctgc

SEQ ID NO: 898 - DNA, 21 bp, Homo sapiens
tttcaccagggcagccatggg

SEQ ID NO: 899 - DNA, 21 bp, Homo sapiens
tcctttcctgtagactgctct

SEQ ID NO: 900 - DNA, 21 bp, Homo sapiens
cacagtttacccacaatgata

SEQ ID NO: 901 - DNA, 21 bp, Homo sapiens
ggaagtggtgggctattgcga

SEQ ID NO: 902 - DNA, 21 bp, Homo sapiens
agaaatgatgcggcgacagca

SEQ ID NO: 903 - DNA, 21 bp, Homo sapiens
catgcctcaagtaagagtttc

SEQ ID NO: 904 - DNA, 21 bp, Homo sapiens
cgctctttctgccctgcttca

SEQ ID NO: 905 - DNA, 21 bp, Homo sapiens
ggcacgtggcctggctcatct

SEQ ID NO: 906 - DNA, 21 bp, Homo sapiens
tttaaaggaaagcttcaagat

SEQ ID NO: 907 - DNA, 21 bp, Homo sapiens
tccgttccgccgccgtcaagg

SEQ ID NO: 908 - DNA, 21 bp, Homo sapiens
gttggggcatatgttggtggc

SEQ ID NO: 909 - DNA, 22 bp, Homo sapiens
tccttcagtttcttctgtagtt

SEQ ID NO: 910 - DNA, 21 bp, Homo sapiens
gaacaacatcgtggggaaaga

SEQ ID NO: 911 - DNA, 21 bp, Homo sapiens
taccgccaggcgcccggcagt

SEQ ID NO: 912 - DNA, 21 bp, Homo sapiens
atgccacaagcgtagtccccc

SEQ ID NO: 913 - DNA, 21 bp, Homo sapiens
gctggagtctttaaacatcag

SEQ ID NO: 914 - DNA, 21 bp, Homo sapiens
ctttggcagagaggcttaagg

SEQ ID NO: 915 - DNA, 21 bp, Homo sapiens
caaatgtcactagcccctgta

SEQ ID NO: 916 - DNA, 21 bp, Homo sapiens
acagttctacatttcagagac

SEQ ID NO: 917 - DNA, 21 bp, Homo sapiens
tttcaccagggcagccatggg

SEQ ID NO: 918 - DNA, 21 bp, Homo sapiens
tcatttcaccagggcagccat

SEQ ID NO: 919 - DNA, 21 bp, Homo sapiens
cagtggaatgtgtgaaatcca

SEQ ID NO: 920 - DNA, 21 bp, Homo sapiens
gagaaagtcatttggcatctg

SEQ ID NO: 921 - DNA, 21 bp, Homo sapiens
ctaggttggcctgggtgctgg

SEQ ID NO: 922 - DNA, 21 bp, Homo sapiens
aggctcactccggagcttcca

SEQ ID NO: 923 - DNA, 21 bp, Homo sapiens
gtcctcacccgtttacctgat

SEQ ID NO: 924 - DNA, 21 bp, Homo sapiens
gctttttccaggtcctctcct

SEQ ID NO: 925 - DNA, 21 bp, Homo sapiens
ggggtttcccgtttgtccctc

SEQ ID NO: 926 - DNA, 21 bp, Homo sapiens
catgactccccgccgccccgg

SEQ ID NO: 927 - DNA, 21 bp, Homo sapiens
aaatttacacgaatgcagaaa

SEQ ID NO: 928 - DNA, 21 bp, Homo sapiens
agggggccggccacatcatca

SEQ ID NO: 929 - DNA, 21 bp, Homo sapiens
acacaggccccctctttgtgt

SEQ ID NO: 930 - DNA, 21 bp, Homo sapiens
acaacttcggcggttgagtag

SEQ ID NO: 931 - DNA, 21 bp, Homo sapiens
ccatattactttttttctgtc

SEQ ID NO: 932 - DNA, 21 bp, Homo sapiens
aactcctccactgactctgca

SEQ ID NO: 933 - DNA, 21 bp, Homo sapiens
ctggtatgttcgtatcggggt

SEQ ID NO: 934 - DNA, 21 bp, Homo sapiens
tctagctgccgggccaactct

SEQ ID NO: 935 - DNA, 21 bp, Homo sapiens
agacaatcaaggattggacca

SEQ ID NO: 936 - DNA, 21 bp, Homo sapiens
agaatctaccgttgaagaaga

SEQ ID NO: 937 - DNA, 21 bp, Homo sapiens
cgcctgtggggggagcagcca

SEQ ID NO: 938 - DNA, 21 bp, Homo sapiens
cttgatcacaggcagatcttg

SEQ ID NO: 939 - DNA, 21 bp, Homo sapiens
gactctggaccgtcccatcaa

SEQ ID NO: 940 - DNA, 23 bp, Homo sapiens
tgagtgtggaaagaaggatttga

SEQ ID NO: 941 - DNA, 21 bp, Homo sapiens
atagggaatcccttctactta

SEQ ID NO: 942 - DNA, 21 bp, Homo sapiens
cctgatgatcgcatcgctggg

SEQ ID NO: 943 - DNA, 21 bp, Homo sapiens
agatcttcacggcaacattct

SEQ ID NO: 944 - DNA, 21 bp, Homo sapiens
gtttgaaactgagtgttgcct

SEQ ID NO: 945 - DNA, 21 bp, Homo sapiens
gatgactcccgcagtcaggca

SEQ ID NO: 946 - DNA, 21 bp, Homo sapiens
ttctgagactcgtaacttgca

SEQ ID NO: 947 - DNA, 21 bp, Homo sapiens
gaaacacatcgtagagggcgt

SEQ ID NO: 948 - DNA, 21 bp, Homo sapiens
ggggtcaattcggaaatatgt

SEQ ID NO: 949 - DNA, 21 bp, Homo sapiens
aaatagtctgggaagaataga

SEQ ID NO: 950 - DNA, 21 bp, Homo sapiens
aatggaagccctaattcagct

SEQ ID NO: 951 - DNA, 21 bp, Homo sapiens
tgaatagttccgcttcaccag

SEQ ID NO: 952 - DNA, 21 bp, Homo sapiens
gcctggcaccggtgggtagag

SEQ ID NO: 953 - DNA, 21 bp, Homo sapiens
cagccgtcccggcaggggccc

SEQ ID NO: 954 - DNA, 21 bp, Homo sapiens
tcaccaatggcgtagatgtgg

SEQ ID NO: 955 - DNA, 21 bp, Homo sapiens
aaggctctcccggcaccccag

SEQ ID NO: 956 - DNA, 21 bp, Homo sapiens
taaccggttgcgcattacgtg

SEQ ID NO: 957 - DNA, 21 bp, Homo sapiens
gcatctgcaaaaacgatgtca

SEQ ID NO: 958 - DNA, 21 bp, Homo sapiens
cccaaaaccaccccctactga

SEQ ID NO: 959 - DNA, 21 bp, Homo sapiens
tggacaacgacgaggaggagg

SEQ ID NO: 960 - DNA, 21 bp, Homo sapiens
tcctatttactctgagtggat

SEQ ID NO: 961 - DNA, 21 bp, Homo sapiens
ataagttgtcgtctattagat

SEQ ID NO: 962 - DNA, 21 bp, Homo sapiens
actatcacaaaggcatcgact

SEQ ID NO: 963 - DNA, 21 bp, Homo sapiens
gccagggtttggtttctttgg

SEQ ID NO: 964 - DNA, 21 bp, Homo sapiens
tgctgcagagcgctcttcttg

SEQ ID NO: 965 - DNA, 21 bp, Homo sapiens
ctggagctccgatgccaattc

SEQ ID NO: 966 - DNA, 21 bp, Homo sapiens
gcagtgtgcccgctggggaaa

SEQ ID NO: 967 - DNA, 21 bp, Homo sapiens
tctgggatagagatggggagc

SEQ ID NO: 968 - DNA, 21 bp, Homo sapiens
agccataccagtgtggccagt

SEQ ID NO: 969 - DNA, 21 bp, Homo sapiens
catccttgtcggtggctatga

SEQ ID NO: 970 - DNA, 21 bp, Homo sapiens
ccctgcacacgggtctctgat

SEQ ID NO: 971 - DNA, 21 bp, Homo sapiens
ccgccagcggcgggagaaggg

SEQ ID NO: 972 - DNA, 21 bp, Homo sapiens
agagtaaatcgtatagccaaa

SEQ ID NO: 973 - DNA, 21 bp, Homo sapiens
aataccatcccgcagttcttc

SEQ ID NO: 974 - DNA, 21 bp, Homo sapiens
ggatgctgacgcctgccttcc

SEQ ID NO: 975 - DNA, 21 bp, Homo sapiens
cccagtgggcgggtggccaag

SEQ ID NO: 976 - DNA, 21 bp, Homo sapiens
ttgcagaggcgtcagaattca

SEQ ID NO: 977 - DNA, 21 bp, Homo sapiens
taaacttcgggcctttcaact

SEQ ID NO: 978 - DNA, 21 bp, Homo sapiens
tggcacaccatgactttgcct

SEQ ID NO: 979 - DNA, 21 bp, Homo sapiens
gtaccgagttcggcttctgta

SEQ ID NO: 980 - DNA, 21 bp, Homo sapiens
ccttgatggctatgtccttct

SEQ ID NO: 981 - DNA, 22 bp, Homo sapiens
cattaatttcttcacctgccat

SEQ ID NO: 982 - DNA, 21 bp, Homo sapiens
gccgtctcctgattgttcctc

SEQ ID NO: 983 - DNA, 21 bp, Homo sapiens
gggctgggcacgaggaggcat

SEQ ID NO: 984 - DNA, 21 bp, Homo sapiens
acgtctctatgtatgcactag

SEQ ID NO: 985 - DNA, 21 bp, Homo sapiens
ggatggcgtctgatgggattg

SEQ ID NO: 986 - DNA, 21 bp, Homo sapiens
tacgatgggcggcagcagcca

SEQ ID NO: 987 - DNA, 21 bp, Homo sapiens
caagtcattgtgtatgtcaca

SEQ ID NO: 988 - DNA, 21 bp, Homo sapiens
gtaaatgctggggaggtctgg

SEQ ID NO: 989 - DNA, 21 bp, Homo sapiens
gtagaacttggtaagctgggc

SEQ ID NO: 990 - DNA, 21 bp, Homo sapiens
gagactgctcggcggcgacca

SEQ ID NO: 991 - DNA, 21 bp, Homo sapiens
ctggagtggcgaatgccaggt

SEQ ID NO: 992 - DNA, 21 bp, Homo sapiens
ggaagttgtcgtcatctgcac

SEQ ID NO: 993 - DNA, 21 bp, Homo sapiens
tctcacacagtacttcagtgt

SEQ ID NO: 994 - DNA, 21 bp, Homo sapiens
attttctggcgttgggcctgg

SEQ ID NO: 995 - DNA, 21 bp, Homo sapiens
ccagaccctcggtgtccagca

SEQ ID NO: 996 - DNA, 22 bp, Homo sapiens
tcgccatgccctgtgtggatga

SEQ ID NO: 997 - DNA, 21 bp, Homo sapiens
gctgaaggccgccttaaggct

SEQ ID NO: 998 - DNA, 21 bp, Homo sapiens
gaacctttgcgaacagtggca

SEQ ID NO: 999 - DNA, 22 bp, Homo sapiens
acacttggactgtgtcaaacag

SEQ ID NO: 1000 - DNA, 21 bp, Homo sapiens
ggaagacgtacggggagcaca

SEQ ID NO: 1001 - DNA, 21 bp, Homo sapiens
gttgggtatgcggagcaattc

SEQ ID NO: 1002 - DNA, 21 bp, Homo sapiens
aactcctccaggcagctgaca

SEQ ID NO: 1003 - DNA, 21 bp, Homo sapiens
taggtggtgacgatagaaaag

SEQ ID NO: 1004 - DNA, 21 bp, Homo sapiens
gctagtgcctggttgtctcat

SEQ ID NO: 1005 - DNA, 21 bp, Homo sapiens
ttcgcgacagcggtgaccttg

SEQ ID NO: 1006 - DNA, 21 bp, Homo sapiens
acagcactacttaagtccaag

SEQ ID NO: 1007 - DNA, 21 bp, Homo sapiens
tggtttcttgcctgttaacac

SEQ ID NO: 1008 - DNA, 21 bp, Homo sapiens
tcatgtttgccttctttgcac

SEQ ID NO: 1009 - DNA, 21 bp, Homo sapiens
agaggggcagcaacaccacca

SEQ ID NO: 1010 - DNA, 21 bp, Homo sapiens
acgctacacacgactgcgtct

SEQ ID NO: 1011 - DNA, 21 bp, Homo sapiens
agcgccagcggggtgaccctc

SEQ ID NO: 1012 - DNA, 21 bp, Homo sapiens
tagcttcttactgcagagaac

SEQ ID NO: 1013 - DNA, 21 bp, Homo sapiens
attcgcagccggtcgcgatat

SEQ ID NO: 1014 - DNA, 21 bp, Homo sapiens
aggaaatcctttcggctctct

SEQ ID NO: 1015 - DNA, 21 bp, Homo sapiens
agtcaaactaccaagaaacag

SEQ ID NO: 1016 - DNA, 21 bp, Homo sapiens
ttcaaagaacgtcctgagaag

SEQ ID NO: 1017 - DNA, 21 bp, Homo sapiens
ggttctgagacgggaggagca

SEQ ID NO: 1018 - DNA, 21 bp, Homo sapiens
ggtgaatcagataaaactgct

SEQ ID NO: 1019 - DNA, 21 bp, Homo sapiens
accacgggatttaacattggg

SEQ ID NO: 1020 - DNA, 21 bp, Homo sapiens
tcatttcaccagggcagccat

SEQ ID NO: 1021 - DNA, 21 bp, Homo sapiens
ggaaacggtccctggtgagcc

SEQ ID NO: 1022 - DNA, 21 bp, Homo sapiens
ctcaagttcaaggagtttgtc

SEQ ID NO: 1023 - DNA, 21 bp, Homo sapiens
gtagcctccagaacacgtcca

SEQ ID NO: 1024 - DNA, 21 bp, Homo sapiens
gggaagagccgtgcaataacg

SEQ ID NO: 1025 - DNA, 21 bp, Homo sapiens
ctctgccttgtccacctgcga

SEQ ID NO: 1026 - DNA, 21 bp, Homo sapiens
ctgttccagtcgattcaagat

SEQ ID NO: 1027 - DNA, 21 bp, Homo sapiens
tttccttaggaaaatggactc

SEQ ID NO: 1028 - DNA, 21 bp, Homo sapiens
gagaaagtctcgaagctcttc

SEQ ID NO: 1029 - DNA, 21 bp, Homo sapiens
ggaggagcatatggaaaggct

SEQ ID NO: 1030 - DNA, 21 bp, Homo sapiens
cttggctgaacgcccagttgc

SEQ ID NO: 1031 - DNA, 21 bp, Homo sapiens
aaaaatcactcgcccttctca

SEQ ID NO: 1032 - DNA, 21 bp, Homo sapiens
atcattatgtttccatccatc

SEQ ID NO: 1033 - DNA, 21 bp, Homo sapiens
atagggaatcccttctactta

SEQ ID NO: 1034 - DNA, 21 bp, Homo sapiens
cctcctctgacggattttaga

SEQ ID NO: 1035 - DNA, 21 bp, Homo sapiens
gaccccagatgaaatcttttc

SEQ ID NO: 1036 - DNA, 21 bp, Homo sapiens
tcaagactttgaaaattttta

SEQ ID NO: 1037 - DNA, 21 bp, Homo sapiens
gatgaagcctacaaatatatc

SEQ ID NO: 1038 - DNA, 21 bp, Homo sapiens
accgggctacgggcagcagtg

SEQ ID NO: 1039 - DNA, 21 bp, Homo sapiens
agaatgtagtcatttgaaggt

SEQ ID NO: 1040 - DNA, 21 bp, Homo sapiens
ctgctcccacgcagatccatg

SEQ ID NO: 1041 - DNA, 21 bp, Homo sapiens
caccaagaatcagagaagagg

SEQ ID NO: 1042 - DNA, 21 bp, Homo sapiens
ggaggacagtgttttcgggcc

SEQ ID NO: 1043 - DNA, 21 bp, Homo sapiens
cgatgaatgcgtccacgccca

SEQ ID NO: 1044 - DNA, 21 bp, Homo sapiens
cggccagacggccttcacgtc

SEQ ID NO: 1045 - DNA, 21 bp, Homo sapiens
attgaatcttcgaggaattac

SEQ ID NO: 1046 - DNA, 21 bp, Homo sapiens
gtttgttatgaaataattacc

SEQ ID NO: 1047 - DNA, 21 bp, Homo sapiens
ggcctttgaccgctacatcgc

SEQ ID NO: 1048 - DNA, 21 bp, Homo sapiens
atatataaagcatttgtgcat

SEQ ID NO: 1049 - DNA, 21 bp, Homo sapiens
gcttggatacgtacttggtca

SEQ ID NO: 1050 - DNA, 21 bp, Homo sapiens
atggatttcccgtccatatcc

SEQ ID NO: 1051 - DNA, 21 bp, Homo sapiens
tttaaggcaacggaaggaaaa

SEQ ID NO: 1052 - DNA, 21 bp, Homo sapiens
caggtgacaaggacataggag

SEQ ID NO: 1053 - DNA, 21 bp, Homo sapiens
gccagcacgcgggtcaggtca

SEQ ID NO: 1054 - DNA, 21 bp, Homo sapiens
acttacaccccgccagtcacc

SEQ ID NO: 1055 - DNA, 21 bp, Homo sapiens
atccacttaccagagactctg

SEQ ID NO: 1056 - DNA, 21 bp, Homo sapiens
ttctaggatcgaggaggctct

SEQ ID NO: 1057 - DNA, 21 bp, Homo sapiens
tggagtatactgaagaagaaa

SEQ ID NO: 1058 - DNA, 21 bp, Homo sapiens
cccccgaaaaagctgatgtgc

SEQ ID NO: 1059 - DNA, 21 bp, Homo sapiens
taaaagcgggatcctaaggga

SEQ ID NO: 1060 - DNA, 21 bp, Homo sapiens
gccacagcactgaaagaagca

SEQ ID NO: 1061 - DNA, 21 bp, Homo sapiens
ggtagaggggccatgtggctg

SEQ ID NO: 1062 - DNA, 23 bp, Homo sapiens
cagaggctggtctggcagcaagc

SEQ ID NO: 1063 - DNA, 21 bp, Homo sapiens
catgagatccggaggctggga

SEQ ID NO: 1064 - DNA, 21 bp, Homo sapiens
acttacctccctcaaccagcc

SEQ ID NO: 1065 - DNA, 21 bp, Homo sapiens
tctacacgaacgctaggacag

SEQ ID NO: 1066 - DNA, 21 bp, Homo sapiens
caccaccatagtaaagtgctc

SEQ ID NO: 1067 - DNA, 21 bp, Homo sapiens
gcccaccctgcggtcgctgag

SEQ ID NO: 1068 - DNA, 21 bp, Homo sapiens
agggcgggtgcgtgccggggg

SEQ ID NO: 1069 - DNA, 21 bp, Homo sapiens
aggcccgtgtcggcccggggg

SEQ ID NO: 1070 - DNA, 21 bp, Homo sapiens
gtacaaagaccttgatgaaga

SEQ ID NO: 1071 - DNA, 21 bp, Homo sapiens
accgtgttcagcaccagcctc

SEQ ID NO: 1072 - DNA, 21 bp, Homo sapiens
tcggtggcaatccctgggtgt

SEQ ID NO: 1073 - DNA, 21 bp, Homo sapiens
cagggcgttgcgcttggcata

SEQ ID NO: 1074 - DNA, 21 bp, Homo sapiens
ctttccctcagattcagtgga

SEQ ID NO: 1075 - DNA, 21 bp, Homo sapiens
gccccgcgccgtggcgacctt

SEQ ID NO: 1076 - DNA, 21 bp, Homo sapiens
gtcggaaacctcgaagctgca

SEQ ID NO: 1077 - DNA, 21 bp, Homo sapiens
ctggaagaggaaatgtccgtc

SEQ ID NO: 1078 - DNA, 21 bp, Homo sapiens
gtgaatgcaggtaacacctag

SEQ ID NO: 1079 - DNA, 21 bp, Homo sapiens
gtcattctctatggaatggaa

SEQ ID NO: 1080 - DNA, 21 bp, Homo sapiens
ttcaggttttgatgggaagcc

SEQ ID NO: 1081 - DNA, 21 bp, Homo sapiens
tctgaggtgacgttcttttgg

SEQ ID NO: 1082 - DNA, 21 bp, Homo sapiens
catgaccaaaatttatcatcc

SEQ ID NO: 1083 - DNA, 21 bp, Homo sapiens
agattccggagaggcgtctgg

SEQ ID NO: 1084 - DNA, 21 bp, Homo sapiens
gttctttatgcgacttgaatc

SEQ ID NO: 1085 - DNA, 21 bp, Homo sapiens
gggatggcacgctggagtatg

SEQ ID NO: 1086 - DNA, 21 bp, Homo sapiens
tgtggccagtgctgccaagct

SEQ ID NO: 1087 - DNA, 21 bp, Homo sapiens
ttcccctaggcgcgcattgcg

SEQ ID NO: 1088 - DNA, 21 bp, Homo sapiens
acccagccttctccctctcat

SEQ ID NO: 1089 - DNA, 21 bp, Homo sapiens
atctcaactacggtgaggaag

SEQ ID NO: 1090 - DNA, 21 bp, Homo sapiens
cagctgatgtaaatctacttc

SEQ ID NO: 1091 - DNA, 21 bp, Homo sapiens
agacagaagaggtggcagagg

SEQ ID NO: 1092 - DNA, 21 bp, Homo sapiens
cagcttgtccgtgggctgaca

SEQ ID NO: 1093 - DNA, 21 bp, Homo sapiens
ttcaaagacgatcatctccgt

SEQ ID NO: 1094 - DNA, 21 bp, Homo sapiens
cctggctttccgccagggcct

SEQ ID NO: 1095 - DNA, 21 bp, Homo sapiens
cattgcctgtcctctacctgt

SEQ ID NO: 1096 - DNA, 21 bp, Homo sapiens
atccacttccccagatcatct

SEQ ID NO: 1097 - DNA, 21 bp, Homo sapiens
ataccatttcgaacacatcac

SEQ ID NO: 1098 - DNA, 21 bp, Homo sapiens
gctccttcccctcctccactt

SEQ ID NO: 1099 - DNA, 21 bp, Homo sapiens
gagtattaacccagcctgcaa

SEQ ID NO: 1100 - DNA, 21 bp, Homo sapiens
taacatctgcaggtgtgctag

SEQ ID NO: 1101 - DNA, 21 bp, Homo sapiens
ctaaggcacctttatatgaag

SEQ ID NO: 1102 - DNA, 21 bp, Homo sapiens
gtctccctttcgcacacagta

SEQ ID NO: 1103 - DNA, 21 bp, Homo sapiens
atggcgccgggcatgcttggt

SEQ ID NO: 1104 - DNA, 21 bp, Homo sapiens
tggagctggcgcccctctccg

SEQ ID NO: 1105 - DNA, 21 bp, Homo sapiens
catccagtagtaatgttctaa

SEQ ID NO: 1106 - DNA, 21 bp, Homo sapiens
agaagcacacgtgtaatcacc

SEQ ID NO: 1107 - DNA, 21 bp, Homo sapiens
aggagtctgggacttgtatcc

SEQ ID NO: 1108 - DNA, 21 bp, Homo sapiens
tctgcagcagccagtgcagct

SEQ ID NO: 1109 - DNA, 21 bp, Homo sapiens
caatggttcaaacaaaaggca

SEQ ID NO: 1110 - DNA, 21 bp, Homo sapiens
ataagcatgacgacctatgat

SEQ ID NO: 1111 - DNA, 21 bp, Homo sapiens
atggtgtcctccatgcagcag

SEQ ID NO: 1112 - DNA, 23 bp, Homo sapiens
tgttgactgacagcaggttgatg

SEQ ID NO: 1113 - DNA, 21 bp, Homo sapiens
gcattcactgcgagaagtgca

SEQ ID NO: 1114 - DNA, 21 bp, Homo sapiens
gaagactgctcgatccagggg

SEQ ID NO: 1115 - DNA, 21 bp, Homo sapiens
tcaagctcctccacggaattt

SEQ ID NO: 1116 - DNA, 21 bp, Homo sapiens
atgagaacttgaggctcaaaa

SEQ ID NO: 1117 - DNA, 21 bp, Homo sapiens
cgcatggtgcgagggcgtgtg

SEQ ID NO: 1118 - DNA, 21 bp, Homo sapiens
ttgggataatcgatggcttga

SEQ ID NO: 1119 - DNA, 21 bp, Homo sapiens
ggtccgctgccagggcctgag

SEQ ID NO: 1120 - DNA, 21 bp, Homo sapiens
caatgtgccgctgcacgctgt

SEQ ID NO: 1121 - DNA, 21 bp, Homo sapiens
agcagaaacactgtacaaaga

SEQ ID NO: 1122 - DNA, 21 bp, Homo sapiens
ctccagattctgtttcagcaa

SEQ ID NO: 1123 - DNA, 21 bp, Homo sapiens
ataccttcacgtaggtgcgct

SEQ ID NO: 1124 - DNA, 21 bp, Homo sapiens
gcctccactccagctttatgg

SEQ ID NO: 1125 - DNA, 21 bp, Homo sapiens
ttctcttcctcctgggtgtgt

SEQ ID NO: 1126 - DNA, 21 bp, Homo sapiens
acatttcttgcgtcgtccaca

SEQ ID NO: 1127 - DNA, 21 bp, Homo sapiens
aagaagaaggctgtagcttcc

SEQ ID NO: 1128 - DNA, 21 bp, Homo sapiens
cctgaatactattatcctaat

SEQ ID NO: 1129 - DNA, 21 bp, Homo sapiens
aggtgtcagggggcctcaggg

SEQ ID NO: 1130 - DNA, 21 bp, Homo sapiens
gccacccgacgatgagcccga

SEQ ID NO: 1131 - DNA, 21 bp, Homo sapiens
gatgctcctcggtctcccttc

SEQ ID NO: 1132 - DNA, 21 bp, Homo sapiens
ggagtttctgcagattgactt

SEQ ID NO: 1133 - DNA, 21 bp, Homo sapiens
ttccttttggctttttccatt

SEQ ID NO: 1134 - DNA, 21 bp, Homo sapiens
ttatggccgcatctccgcaca

SEQ ID NO: 1135 - DNA, 21 bp, Homo sapiens
cacccttggcggaaagaacac

SEQ ID NO: 1136 - DNA, 21 bp, Homo sapiens
aagcgccagcggggtgaccct

SEQ ID NO: 1137 - DNA, 21 bp, Homo sapiens
cccagttaattttgatttttc

SEQ ID NO: 1138 - DNA, 21 bp, Homo sapiens
tcttaccttatgttataaaga

SEQ ID NO: 1139 - DNA, 21 bp, Homo sapiens
acttgtgcttctgtagcaggt

SEQ ID NO: 1140 - DNA, 21 bp, Homo sapiens
ataataatcacatcagactct

SEQ ID NO: 1141 - DNA, 21 bp, Homo sapiens
tggtgctgttgctttggggtg

SEQ ID NO: 1142 - DNA, 21 bp, Homo sapiens
ttatttactagattatgatgt

SEQ ID NO: 1143 - DNA, 21 bp, Homo sapiens
ctcgggtgagcgctgtgcagt

SEQ ID NO: 1144 - DNA, 21 bp, Homo sapiens
tactgggaataggagattttg

SEQ ID NO: 1145 - DNA, 21 bp, Homo sapiens
gtgcctcttacttgtgcttga

SEQ ID NO: 1146 - DNA, 21 bp, Homo sapiens
ccactggaaatatatagccta

SEQ ID NO: 1147 - DNA, 21 bp, Homo sapiens
atcctgggggcgttttccgct

SEQ ID NO: 1148 - DNA, 21 bp, Homo sapiens
gcaggatcttggcgtaggatg

SEQ ID NO: 1149 - DNA, 21 bp, Homo sapiens
gaagaggatcggcagaaagtg

SEQ ID NO: 1150 - DNA, 21 bp, Homo sapiens
gctggcctgctcctgcctgcg

SEQ ID NO: 1151 - DNA, 21 bp, Homo sapiens
catcaatgcagtggctgtgag

SEQ ID NO: 1152 - DNA, 21 bp, Homo sapiens
atcaatgcagtggctgtgagt

SEQ ID NO: 1153 - DNA, 21 bp, Homo sapiens
ccacacactgcttgctgtttg

SEQ ID NO: 1154 - DNA, 21 bp, Homo sapiens
ccctggttttggtacccttcc

SEQ ID NO: 1155 - DNA, 21 bp, Homo sapiens
ttgccagatgcgccttcttca

SEQ ID NO: 1156 - DNA, 21 bp, Homo sapiens
cgatgtattcgtagtacccac

SEQ ID NO: 1157 - DNA, 21 bp, Homo sapiens
ctacgggggcgagagctcctc

SEQ ID NO: 1158 - DNA, 21 bp, Homo sapiens
gtccgccctgcgcggcggcgg

SEQ ID NO: 1159 - DNA, 21 bp, Homo sapiens
gcgtaaatgacggggttaagc

SEQ ID NO: 1160 - DNA, 21 bp, Homo sapiens
aaaaattcaattcatttcacc

SEQ ID NO: 1161 - DNA, 21 bp, Homo sapiens
caccttcctctggagagtcct

SEQ ID NO: 1162 - DNA, 21 bp, Homo sapiens
cacttttccagctccagctgg

SEQ ID NO: 1163 - DNA, 21 bp, Homo sapiens
ctcttctccagagctgctttc

SEQ ID NO: 1164 - DNA, 21 bp, Homo sapiens
ttcccccaggcgatgcgtctg

SEQ ID NO: 1165 - DNA, 21 bp, Homo sapiens
ggctgtggaccggtcccagtc

SEQ ID NO: 1166 - DNA, 21 bp, Homo sapiens
gtcagatacacgggtatgtga

SEQ ID NO: 1167 - DNA, 21 bp, Homo sapiens
gaggtgggggaggtgccccag

SEQ ID NO: 1168 - DNA, 21 bp, Homo sapiens
ccagtcttttcgcaaagtgta

SEQ ID NO: 1169 - DNA, 21 bp, Homo sapiens
ccacaagtgggatattcaggt

SEQ ID NO: 1170 - DNA, 21 bp, Homo sapiens
aacgggtcttcagcttcatct

SEQ ID NO: 1171 - DNA, 21 bp, Homo sapiens
tccttcaaatgttttacacct

SEQ ID NO: 1172 - DNA, 21 bp, Homo sapiens
atgatcctcttaatccaaatc

SEQ ID NO: 1173 - DNA, 21 bp, Homo sapiens
gctcagactcgtagaaggaat

SEQ ID NO: 1174 - DNA, 21 bp, Homo sapiens
ctcacttccacccagcctttc

SEQ ID NO: 1175 - DNA, 21 bp, Homo sapiens
gtggctgtcattcatccaagc

SEQ ID NO: 1176 - DNA, 21 bp, Homo sapiens
ccccaggattctggcctgctt

SEQ ID NO: 1177 - DNA, 21 bp, Homo sapiens
taaggagtggccgaactcatg

SEQ ID NO: 1178 - DNA, 21 bp, Homo sapiens
aagatggatacgactgccatg

SEQ ID NO: 1179 - DNA, 21 bp, Homo sapiens
caacgccaccgtggccgtgga

SEQ ID NO: 1180 - DNA, 21 bp, Homo sapiens
gttccaaaacgtgaggcgcgt

SEQ ID NO: 1181 - DNA, 21 bp, Homo sapiens
ctgcattcaatctatggggat

SEQ ID NO: 1182 - DNA, 21 bp, Homo sapiens
ttattcatccgggatggaagc

SEQ ID NO: 1183 - DNA, 21 bp, Homo sapiens
cacatcgagccgccgtggggt

SEQ ID NO: 1184 - DNA, 21 bp, Homo sapiens
ttgaatcttctaagcgcaagt

SEQ ID NO: 1185 - DNA, 21 bp, Homo sapiens
gattcgggttttcagaccacc

SEQ ID NO: 1186 - DNA, 23 bp, Homo sapiens
tcacgtactccttcttcttcagt

SEQ ID NO: 1187 - DNA, 21 bp, Homo sapiens
gtggggtgagtggtaacatag

SEQ ID NO: 1188 - DNA, 21 bp, Homo sapiens
caaaatgtgatgcttattcaa

SEQ ID NO: 1189 - DNA, 21 bp, Homo sapiens
agacggagtcgtctgctctct

SEQ ID NO: 1190 - DNA, 21 bp, Homo sapiens
tacggtgtccgagagatggta

SEQ ID NO: 1191 - DNA, 21 bp, Homo sapiens
cacaagattcgccaggcactg

SEQ ID NO: 1192 - DNA, 21 bp, Homo sapiens
ctcaacattgacttggccccc

SEQ ID NO: 1193 - DNA, 21 bp, Homo sapiens
acagcctctgggtctcgtcac

SEQ ID NO: 1194 - DNA, 21 bp, Homo sapiens
tgaggtgagcggcacaggtgg

SEQ ID NO: 1195 - DNA, 21 bp, Homo sapiens
ggttgaacctcaggaagtggt

SEQ ID NO: 1196 - DNA, 21 bp, Homo sapiens
aaggggaatgggtaagtgttg

SEQ ID NO: 1197 - DNA, 21 bp, Homo sapiens
ccaccaagtcggtggttgtga

SEQ ID NO: 1198 - DNA, 21 bp, Homo sapiens
tgtgaacggcgtctggagaga

SEQ ID NO: 1199 - DNA, 21 bp, Homo sapiens
ggctcccctcggcactgactg

SEQ ID NO: 1200 - DNA, 21 bp, Homo sapiens
ggttctagtggaggtatctac

SEQ ID NO: 1201 - DNA, 21 bp, Homo sapiens
caatggtgttaaattcttggc

SEQ ID NO: 1202 - DNA, 21 bp, Homo sapiens
ctggggccttcggctttgaca

SEQ ID NO: 1203 - DNA, 21 bp, Homo sapiens
tgagtttcccgtcagagttca

SEQ ID NO: 1204 - DNA, 21 bp, Homo sapiens
ggaacactgactcttccctgc

SEQ ID NO: 1205 - DNA, 21 bp, Homo sapiens
tacatgatagatgctgcagat

SEQ ID NO: 1206 - DNA, 21 bp, Homo sapiens
cctggcacctgctctgtgcag

SEQ ID NO: 1207 - DNA, 21 bp, Homo sapiens
cctcttcctcggtgtccttga

SEQ ID NO: 1208 - DNA, 21 bp, Homo sapiens
ctggaagttcttgtgactgac

SEQ ID NO: 1209 - DNA, 21 bp, Homo sapiens
aacatttccagtcaaccaaca

SEQ ID NO: 1210 - DNA, 21 bp, Homo sapiens
tgccatcagccgggtccagat

SEQ ID NO: 1211 - DNA, 21 bp, Homo sapiens
gataccctgaatgacggcatc

SEQ ID NO: 1212 - DNA, 21 bp, Homo sapiens
gcacgccccaggtcaccgtgg

SEQ ID NO: 1213 - DNA, 21 bp, Homo sapiens
gatgccattggctccaccatg

SEQ ID NO: 1214 - DNA, 21 bp, Homo sapiens
tacagctggccagagccccct

SEQ ID NO: 1215 - DNA, 21 bp, Homo sapiens
cgcttcttgccagaacagttc

SEQ ID NO: 1216 - DNA, 21 bp, Homo sapiens
ctacttctccgctgcaggaaa

SEQ ID NO: 1217 - DNA, 21 bp, Homo sapiens
cccctcccccgtcctaattga

SEQ ID NO: 1218 - DNA, 21 bp, Homo sapiens
tgcacctctcggagtgtatct

SEQ ID NO: 1219 - DNA, 21 bp, Homo sapiens
aagggtttcacatcaaccata

SEQ ID NO: 1220 - DNA, 21 bp, Homo sapiens
gcagcgctcatggtgggggca

SEQ ID NO: 1221 - DNA, 21 bp, Homo sapiens
caacagccccgccctgcacat

SEQ ID NO: 1222 - DNA, 21 bp, Homo sapiens
ggacaaggccgtctctgtgct

SEQ ID NO: 1223 - DNA, 21 bp, Homo sapiens
gagctcctcagccaggttccc

SEQ ID NO: 1224 - DNA, 21 bp, Homo sapiens
tgtttggaagccaaaaccaga

SEQ ID NO: 1225 - DNA, 21 bp, Homo sapiens
ttggggccttcgtcagggtcc

SEQ ID NO: 1226 - DNA, 21 bp, Homo sapiens
gagcctgatccggggatggcc

SEQ ID NO: 1227 - DNA, 21 bp, Homo sapiens
gaggaagggcgtaaagaactc

SEQ ID NO: 1228 - DNA, 21 bp, Homo sapiens
gtgtgtcatagctaccatagc

SEQ ID NO: 1229 - DNA, 21 bp, Homo sapiens
catgtacatacggcccacatc

SEQ ID NO: 1230 - DNA, 21 bp, Homo sapiens
cgtaatgttccttttccttgt

SEQ ID NO: 1231 - DNA, 22 bp, Homo sapiens
tcaacacatatgaagtattttt

SEQ ID NO: 1232 - DNA, 21 bp, Homo sapiens
ctagcagacacgctgggcagg

SEQ ID NO: 1233 - DNA, 21 bp, Homo sapiens
acctcactccgccaaattcca

SEQ ID NO: 1234 - DNA, 21 bp, Homo sapiens
tcctctgtcacctgctcccct

SEQ ID NO: 1235 - DNA, 21 bp, Homo sapiens
agaattcccacggcaccctgg

SEQ ID NO: 1236 - DNA, 21 bp, Homo sapiens
ccccaacatgggcctttgtac

SEQ ID NO: 1237 - DNA, 21 bp, Homo sapiens
ccaatgctgacgtggcctcat

SEQ ID NO: 1238 - DNA, 21 bp, Homo sapiens
tcatataaaagtgcacctgct

SEQ ID NO: 1239 - DNA, 21 bp, Homo sapiens
agtacctggcgtgttgtcacg

SEQ ID NO: 1240 - DNA, 21 bp, Homo sapiens
ggcggctgagcgcagggcccg

SEQ ID NO: 1241 - DNA, 21 bp, Homo sapiens
gcacgaagtcgtctcgtatca

SEQ ID NO: 1242 - DNA, 21 bp, Homo sapiens
tgaaatcactgagcaggagaa

SEQ ID NO: 1243 - DNA, 21 bp, Homo sapiens
gcccgaaaggagagcctgtga

SEQ ID NO: 1244 - DNA, 21 bp, Homo sapiens
tggtgggctgcggcggacacg

SEQ ID NO: 1245 - DNA, 21 bp, Homo sapiens
aagcagagtcgttctgatggc

SEQ ID NO: 1246 - DNA, 21 bp, Homo sapiens
gctatggctacggaggctata

SEQ ID NO: 1247 - DNA, 21 bp, Homo sapiens
cccatcgtaaccttgtacccg

SEQ ID NO: 1248 - DNA, 21 bp, Homo sapiens
aggagagtacccggcttggtg

SEQ ID NO: 1249 - DNA, 21 bp, Homo sapiens
caaaaaggttttagttcctgt

SEQ ID NO: 1250 - DNA, 21 bp, Homo sapiens
tgcttcccagggctgatggaa

SEQ ID NO: 1251 - DNA, 21 bp, Homo sapiens
ttggcgctccgtcagcagctc

SEQ ID NO: 1252 - DNA, 21 bp, Homo sapiens
gtcatggatcgctggaagctt

SEQ ID NO: 1253 - DNA, 21 bp, Homo sapiens
aacagcattggaaatcagatt

SEQ ID NO: 1254 - DNA, 21 bp, Homo sapiens
cagttatttcttaagtaaatt

SEQ ID NO: 1255 - DNA, 21 bp, Homo sapiens
attttcaggaggtatgtgttt

SEQ ID NO: 1256 - DNA, 21 bp, Homo sapiens
ctccgaccccgcggcctacgc

SEQ ID NO: 1257 - DNA, 21 bp, Homo sapiens
ctggggcgttctgtgtgtcat

SEQ ID NO: 1258 - DNA, 22 bp, Homo sapiens
cagtggcaggaaggggtcataa

SEQ ID NO: 1259 - DNA, 21 bp, Homo sapiens
ttggtagtccgtctagttggg

SEQ ID NO: 1260 - DNA, 21 bp, Homo sapiens
actggtgagatggaaagtgaa

SEQ ID NO: 1261 - DNA, 21 bp, Homo sapiens
gcccctgttccctcacgttct

SEQ ID NO: 1262 - DNA, 21 bp, Homo sapiens
tacacgtggcgccagttcttc

SEQ ID NO: 1263 - DNA, 21 bp, Homo sapiens
cttccagccttttttggtttt

SEQ ID NO: 1264 - DNA, 21 bp, Homo sapiens
caggcccgtgaacagactccg

SEQ ID NO: 1265 - DNA, 21 bp, Homo sapiens
ctgccccgactgcgggaagac

SEQ ID NO: 1266 - DNA, 21 bp, Homo sapiens
aggcccagcccgtacatcttc

SEQ ID NO: 1267 - DNA, 21 bp, Homo sapiens
agccatcatcagttgtgagta

SEQ ID NO: 1268 - DNA, 21 bp, Homo sapiens
acaagagtttgtggaggtaaa

SEQ ID NO: 1269 - DNA, 21 bp, Homo sapiens
gctgcgggcacggagccagct

SEQ ID NO: 1270 - DNA, 21 bp, Homo sapiens
tttctccctacaaaagaaaaa

SEQ ID NO: 1271 - DNA, 21 bp, Homo sapiens
gctgcccttatgactaaaaga

SEQ ID NO: 1272 - DNA, 21 bp, Homo sapiens
atgactaaaagatttcccaca

SEQ ID NO: 1273 - DNA, 21 bp, Homo sapiens
aggccttcaatgaggtgatca

SEQ ID NO: 1274 - DNA, 21 bp, Homo sapiens
gcacgtcgagggcgatgaaca

SEQ ID NO: 1275 - DNA, 21 bp, Homo sapiens
actaatatttgctctgatggg

SEQ ID NO: 1276 - DNA, 21 bp, Homo sapiens
aaggaataggccgctaggatg

SEQ ID NO: 1277 - DNA, 21 bp, Homo sapiens
agcaaagaggtatatggtagg

SEQ ID NO: 1278 - DNA, 21 bp, Homo sapiens
ttacggtggcggagctgcggg

SEQ ID NO: 1279 - DNA, 21 bp, Homo sapiens
ctaaattccgcgcagtcttcc

SEQ ID NO: 1280 - DNA, 21 bp, Homo sapiens
ttttaggatgcgtagtacaat

SEQ ID NO: 1281 - DNA, 22 bp, Homo sapiens
ttaacggctagtaggattggag

SEQ ID NO: 1282 - DNA, 21 bp, Homo sapiens
gcgccccgccgttctgaggct

SEQ ID NO: 1283 - DNA, 21 bp, Homo sapiens
aggccgggttgtaaggaggct

SEQ ID NO: 1284 - DNA, 21 bp, Homo sapiens
atgacgggctcgcctaggagg

SEQ ID NO: 1285 - DNA, 21 bp, Homo sapiens
ggtattcccacgaacaccacg

SEQ ID NO: 1286 - DNA, 21 bp, Homo sapiens
aagcctacaaatatatcactg

SEQ ID NO: 1287 - DNA, 21 bp, Homo sapiens
gatgaagcctacaaatatatc

SEQ ID NO: 1288 - DNA, 21 bp, Homo sapiens
tctaccgccaggtgacctatt

SEQ ID NO: 1289 - DNA, 21 bp, Homo sapiens
gagaatactgggtgtagtagg

SEQ ID NO: 1290 - DNA, 21 bp, Homo sapiens
ctgtgggccacggccagggtg

SEQ ID NO: 1291 - DNA, 21 bp, Homo sapiens
aggattacctgtggctgaagg

SEQ ID NO: 1292 - DNA, 21 bp, Homo sapiens
tgtgttgctctcgtggtggct

SEQ ID NO: 1293 - DNA, 21 bp, Homo sapiens
aagctgtcgacttggccgtct

SEQ ID NO: 1294 - DNA, 21 bp, Homo sapiens
cctgacattctcactgggccc

SEQ ID NO: 1295 - DNA, 21 bp, Homo sapiens
caatgtggaaaaaccttcact

SEQ ID NO: 1296 - DNA, 21 bp, Homo sapiens
aactgtgccaatatccagatt

SEQ ID NO: 1297 - DNA, 21 bp, Homo sapiens
agttcctggagcgccagtttt

SEQ ID NO: 1298 - DNA, 21 bp, Homo sapiens
gctgcacggccgctttcccgt

SEQ ID NO: 1299 - DNA, 21 bp, Homo sapiens
ggcggtgtccgtgccccggga

SEQ ID NO: 1300 - DNA, 21 bp, Homo sapiens
catctcatcccgacacagcac

SEQ ID NO: 1301 - DNA, 21 bp, Homo sapiens
aattcagatatgtttaaatat

SEQ ID NO: 1302 - DNA, 21 bp, Homo sapiens
ggggtggcccccggctacgag

SEQ ID NO: 1303 - DNA, 21 bp, Homo sapiens
cggctatgtcggtgggacaaa

SEQ ID NO: 1304 - DNA, 21 bp, Homo sapiens
atcatttcttcggtaagttta

SEQ ID NO: 1305 - DNA, 21 bp, Homo sapiens
cttcatgacagctgtcccaca

SEQ ID NO: 1306 - DNA, 21 bp, Homo sapiens
tccatacccatgtgggctact

SEQ ID NO: 1307 - DNA, 21 bp, Homo sapiens
atatggtgatcggatggttca

SEQ ID NO: 1308 - DNA, 21 bp, Homo sapiens
aaacccctacctaaggtaaac

SEQ ID NO: 1309 - DNA, 21 bp, Homo sapiens
atgcaaaaagttgaagaggaa

SEQ ID NO: 1310 - DNA, 22 bp, Homo sapiens
ttatccagctgagaaagacgag

SEQ ID NO: 1311 - DNA, 21 bp, Homo sapiens
cccaaatgtcgtagaccatga

SEQ ID NO: 1312 - DNA, 21 bp, Homo sapiens
ccccatgggacgaggtcatca

SEQ ID NO: 1313 - DNA, 21 bp, Homo sapiens
gggaaatacacgtggacaata

SEQ ID NO: 1314 - DNA, 21 bp, Homo sapiens
ctgaaaggagacaaggtaatc

SEQ ID NO: 1315 - DNA, 21 bp, Homo sapiens
ctatgctgtccagcctccgct

SEQ ID NO: 1316 - DNA, 21 bp, Homo sapiens
acctccaagtccaatgatgcc

SEQ ID NO: 1317 - DNA, 21 bp, Homo sapiens
ggatgagccagaaatggcagt

SEQ ID NO: 1318 - DNA, 21 bp, Homo sapiens
cgaggtaaaagttttggtatt

SEQ ID NO: 1319 - DNA, 21 bp, Homo sapiens
gtgtatattcggcatcaaggc

SEQ ID NO: 1320 - DNA, 21 bp, Homo sapiens
ccagcaaccaatcattggcat

SEQ ID NO: 1321 - DNA, 21 bp, Homo sapiens
tgaacagatcgacaaggccca

SEQ ID NO: 1322 - DNA, 21 bp, Homo sapiens
acaaattgctgtccaccgaaa

SEQ ID NO: 1323 - DNA, 21 bp, Homo sapiens
tgcattgcatcatagcattcc

SEQ ID NO: 1324 - DNA, 21 bp, Homo sapiens
ctcatcaaactttttctgcag

SEQ ID NO: 1325 - DNA, 21 bp, Homo sapiens
aggtgctgatcgtggtcttga

SEQ ID NO: 1326 - DNA, 21 bp, Homo sapiens
caccacagcccgcgggtaagc

SEQ ID NO: 1327 - DNA, 21 bp, Homo sapiens
ctccaacttcgacaaagagtt

SEQ ID NO: 1328 - DNA, 21 bp, Homo sapiens
attctggtcacggtgtacata

SEQ ID NO: 1329 - DNA, 21 bp, Homo sapiens
tttcaattgcgtagccaggag

SEQ ID NO: 1330 - DNA, 21 bp, Homo sapiens
cgctacactcgacagggcacc

SEQ ID NO: 1331 - DNA, 21 bp, Homo sapiens
cctgcccttcggcattctggg

SEQ ID NO: 1332 - DNA, 21 bp, Homo sapiens
gctggtctggctgttccggac

SEQ ID NO: 1333 - DNA, 21 bp, Homo sapiens
ctgtgatacctgtttcaacaa

SEQ ID NO: 1334 - DNA, 21 bp, Homo sapiens
caatcatgtcgagaaataacg

SEQ ID NO: 1335 - DNA, 21 bp, Homo sapiens
cagttaatgcgtcaaatgaaa

SEQ ID NO: 1336 - DNA, 21 bp, Homo sapiens
gtttccattacgactcaattg

SEQ ID NO: 1337 - DNA, 21 bp, Homo sapiens
ccagcaggaggttctcggtct

SEQ ID NO: 1338 - DNA, 21 bp, Homo sapiens
gccagaaggacgcattcgact

SEQ ID NO: 1339 - DNA, 20 bp, Homo sapiens
tacaatggcaggtttatttc

SEQ ID NO: 1340 - DNA, 21 bp, Homo sapiens
ggtaacgggacaacttgcagg

SEQ ID NO: 1341 - DNA, 21 bp, Homo sapiens
gtgaatgagcgagagtgcttt

SEQ ID NO: 1342 - DNA, 21 bp, Homo sapiens
ctccatggaggttcttcttcc

SEQ ID NO: 1343 - DNA, 21 bp, Homo sapiens
acatcttatgcattcatcatt

SEQ ID NO: 1344 - DNA, 21 bp, Homo sapiens
gagatcttttattttgtttcc

SEQ ID NO: 1345 - DNA, 21 bp, Homo sapiens
acatccaggggaggcaagaag

SEQ ID NO: 1346 - DNA, 21 bp, Homo sapiens
cccacaggcaattactaaaga

SEQ ID NO: 1347 - DNA, 21 bp, Homo sapiens
tgcgggtccagaatgagggaa

SEQ ID NO: 1348 - DNA, 21 bp, Homo sapiens
ctttgaatgtgggagggaaga

SEQ ID NO: 1349 - DNA, 21 bp, Homo sapiens
cagtgttttcggacctggcag

SEQ ID NO: 1350 - DNA, 21 bp, Homo sapiens
gctccagggacgtcgtggatg

SEQ ID NO: 1351 - DNA, 21 bp, Homo sapiens
ctctcttttttggcactcttg

SEQ ID NO: 1352 - DNA, 21 bp, Homo sapiens
tacaattagccgaatggacag

SEQ ID NO: 1353 - DNA, 21 bp, Homo sapiens
ctgctccagcgcttactccga

SEQ ID NO: 1354 - DNA, 21 bp, Homo sapiens
gaaaagatgggagagaaatca

SEQ ID NO: 1355 - DNA, 21 bp, Homo sapiens
catccaaccccgcagctggga

SEQ ID NO: 1356 - DNA, 21 bp, Homo sapiens
ctttcaggagcggcagatcaa

SEQ ID NO: 1357 - DNA, 21 bp, Homo sapiens
tgcccggcaggagtcatggga

SEQ ID NO: 1358 - DNA, 21 bp, Homo sapiens
cagatcatcagaggaaatatg

SEQ ID NO: 1359 - DNA, 21 bp, Homo sapiens
ccacactgccccagctggaca

SEQ ID NO: 1360 - DNA, 21 bp, Homo sapiens
aagttaaaagcgtttagtggc

SEQ ID NO: 1361 - DNA, 21 bp, Homo sapiens
ttccccagttgaccagcccta

SEQ ID NO: 1362 - DNA, 21 bp, Homo sapiens
aacctgccccgggtgctgtca

SEQ ID NO: 1363 - DNA, 21 bp, Homo sapiens
ccggatgtaccctgggtgcgg

SEQ ID NO: 1364 - DNA, 21 bp, Homo sapiens
agacttgaaggcgtatacagg

SEQ ID NO: 1365 - DNA, 21 bp, Homo sapiens
gtatagtctgtccttatgcga

SEQ ID NO: 1366 - DNA, 21 bp, Homo sapiens
taggcacctgccccgtttttt

SEQ ID NO: 1367 - DNA, 21 bp, Homo sapiens
gagtgtgggcggggctttagc

SEQ ID NO: 1368 - DNA, 21 bp, Homo sapiens
ctccaagtcatttagtgatca

SEQ ID NO: 1369 - DNA, 21 bp, Homo sapiens
agagggtcgtcgcaaagcttt

SEQ ID NO: 1370 - DNA, 21 bp, Homo sapiens
aaccaacttccggcatgatag

SEQ ID NO: 1371 - DNA, 21 bp, Homo sapiens
tccggagcccgccttcttgat

SEQ ID NO: 1372 - DNA, 21 bp, Homo sapiens
cacctgttaataaggtaaggg

SEQ ID NO: 1373 - DNA, 21 bp, Homo sapiens
tgctcaggaccgaaactggga

SEQ ID NO: 1374 - DNA, 21 bp, Homo sapiens
ggtgttgtggaaaggaaacaa

SEQ ID NO: 1375 - DNA, 21 bp, Homo sapiens
caaggctcgcgttagtgccac

SEQ ID NO: 1376 - DNA, 21 bp, Homo sapiens
tgtgctcctcctcctgctcct

SEQ ID NO: 1377 - DNA, 21 bp, Homo sapiens
gctgatactctccactgaggc

SEQ ID NO: 1378 - DNA, 21 bp, Homo sapiens
gagctcatagagcttatcaac

SEQ ID NO: 1379 - DNA, 21 bp, Homo sapiens
ccttgaccgtgaccctggagt

SEQ ID NO: 1380 - DNA, 21 bp, Homo sapiens
catccaggttatggattcctt

SEQ ID NO: 1381 - DNA, 21 bp, Homo sapiens
ccaccgactccaggtgacgca

SEQ ID NO: 1382 - DNA, 21 bp, Homo sapiens
catctgcaccgcgaggaacct

SEQ ID NO: 1383 - DNA, 21 bp, Homo sapiens
gcagtgtgacgtttctggctg

SEQ ID NO: 1384 - DNA, 21 bp, Homo sapiens
ggaggggctcggcagcctcca

SEQ ID NO: 1385 - DNA, 21 bp, Homo sapiens
gagcaacaccatatcatggga

SEQ ID NO: 1386 - DNA, 21 bp, Homo sapiens
tgacggttccggaatgtctgc

SEQ ID NO: 1387 - DNA, 21 bp, Homo sapiens
gtaacccacgcaggccatcat

SEQ ID NO: 1388 - DNA, 21 bp, Homo sapiens
tccatacttatttctgaatac

SEQ ID NO: 1389 - DNA, 21 bp, Homo sapiens
cttgcacttcgcacacatagt

SEQ ID NO: 1390 - DNA, 21 bp, Homo sapiens
ttttcctgctaaaatgataga

SEQ ID NO: 1391 - DNA, 21 bp, Homo sapiens
ctggccctgcgcccccctgta

SEQ ID NO: 1392 - DNA, 21 bp, Homo sapiens
gcccggcgtccgggggcacac

SEQ ID NO: 1393 - DNA, 21 bp, Homo sapiens
atgttatccccccgcctgtgg

SEQ ID NO: 1394 - DNA, 21 bp, Homo sapiens
tcaccagcgacggctggagag

SEQ ID NO: 1395 - DNA, 22 bp, Homo sapiens
gagcggctggccgcttcacaga

SEQ ID NO: 1396 - DNA, 21 bp, Homo sapiens
cccattcccacgacttatgct

SEQ ID NO: 1397 - DNA, 21 bp, Homo sapiens
ggaacagggcgctgctccatg

SEQ ID NO: 1398 - DNA, 21 bp, Homo sapiens
ctcatgtttgccttctttgca

SEQ ID NO: 1399 - DNA, 21 bp, Homo sapiens
attatggccgcatctccgcac

SEQ ID NO: 1400 - DNA, 21 bp, Homo sapiens
gccgcatgctgcccgtggacg

SEQ ID NO: 1401 - DNA, 21 bp, Homo sapiens
cctgccccgactgcgggaaga

SEQ ID NO: 1402 - DNA, 21 bp, Homo sapiens
gcctatggtcgttttgtggcc

SEQ ID NO: 1403 - DNA, 21 bp, Homo sapiens
cataggtgtcgttgacaggag

SEQ ID NO: 1404 - DNA, 21 bp, Homo sapiens
cagatgtggacgccaagattc

SEQ ID NO: 1405 - DNA, 21 bp, Homo sapiens
tagccacagcggatcttcact

SEQ ID NO: 1406 - DNA, 21 bp, Homo sapiens
ctctagatacgtgttcaggaa

SEQ ID NO: 1407 - DNA, 21 bp, Homo sapiens
cctgctctccgcctcctccaa

SEQ ID NO: 1408 - DNA, 21 bp, Homo sapiens
tatggtgaaactggcaaaagg

SEQ ID NO: 1409 - DNA, 21 bp, Homo sapiens
aacaggtctatgttgacctaa

SEQ ID NO: 1410 - DNA, 21 bp, Homo sapiens
ttacctttccgatcaggtttg

SEQ ID NO: 1411 - DNA, 21 bp, Homo sapiens
tcttgtttttaagatcttcca

SEQ ID NO: 1412 - DNA, 21 bp, Homo sapiens
gaaacggtccctggtgagcca

SEQ ID NO: 1413 - DNA, 21 bp, Homo sapiens
cctcaagttcaaggagtttgt

SEQ ID NO: 1414 - DNA, 21 bp, Homo sapiens
aactgaatgcgtcttctacac

SEQ ID NO: 1415 - DNA, 21 bp, Homo sapiens
ctgccaggacgtctcggtcgt

SEQ ID NO: 1416 - DNA, 21 bp, Homo sapiens
gatctggtgtcccgttttgcg

SEQ ID NO: 1417 - DNA, 21 bp, Homo sapiens
cacctgctggcctgctcctgc

SEQ ID NO: 1418 - DNA, 21 bp, Homo sapiens
tcccagaaaaccttccaaggc

SEQ ID NO: 1419 - DNA, 21 bp, Homo sapiens
gagaagaagcgcaagcgcacg

SEQ ID NO: 1420 - DNA, 21 bp, Homo sapiens
aggggtgagagaaagccaaaa

SEQ ID NO: 1421 - DNA, 21 bp, Homo sapiens
ttaccatcccgtggttgcact

SEQ ID NO: 1422 - DNA, 21 bp, Homo sapiens
cagtttggcgcggaacgggtg

SEQ ID NO: 1423 - DNA, 21 bp, Homo sapiens
atgacaggcattgaaactcca

SEQ ID NO: 1424 - DNA, 21 bp, Homo sapiens
atcagcattacgctcgttgag

SEQ ID NO: 1425 - DNA, 21 bp, Homo sapiens
acagtgacagcgacagccaaa

SEQ ID NO: 1426 - DNA, 22 bp, Homo sapiens
tggccagccctaccagccactt

SEQ ID NO: 1427 - DNA, 21 bp, Homo sapiens
tttggccatttccttctttcg

SEQ ID NO: 1428 - DNA, 21 bp, Homo sapiens
tatcatatgcgaagcgcaggt

SEQ ID NO: 1429 - DNA, 21 bp, Homo sapiens
gaggcgtggcgtggccacccc

SEQ ID NO: 1430 - DNA, 21 bp, Homo sapiens
caactatcccgccatggcagt

SEQ ID NO: 1431 - DNA, 21 bp, Homo sapiens
atttagctgtgactgtactac

SEQ ID NO: 1432 - DNA, 21 bp, Homo sapiens
gtgctgtgcagccctgtggag

SEQ ID NO: 1433 - DNA, 21 bp, Homo sapiens
tcctttgtggcgcatgacaaa

SEQ ID NO: 1434 - DNA, 21 bp, Homo sapiens
aagtcactgcgacatgattaa

SEQ ID NO: 1435 - DNA, 21 bp, Homo sapiens
gtaagacaccgtcttggtggc

SEQ ID NO: 1436 - DNA, 21 bp, Homo sapiens
tcccacttcagcatcttctct

SEQ ID NO: 1437 - DNA, 21 bp, Homo sapiens
ccactggagcgtcatttccag

SEQ ID NO: 1438 - DNA, 21 bp, Homo sapiens
atggctgtttagaagccttct

SEQ ID NO: 1439 - DNA, 21 bp, Homo sapiens
gcaacctctcgtgtgtggaca

SEQ ID NO: 1440 - DNA, 21 bp, Homo sapiens
tccatatgcttcatggcttgc

SEQ ID NO: 1441 - DNA, 21 bp, Homo sapiens
accgtgtgcttagcatctgga

SEQ ID NO: 1442 - DNA, 21 bp, Homo sapiens
actggattcccaggaggaatc

SEQ ID NO: 1443 - DNA, 21 bp, Homo sapiens
acctgaccaggcagaacgcag

SEQ ID NO: 1444 - DNA, 21 bp, Homo sapiens
cttccatcccataccctacta

SEQ ID NO: 1445 - DNA, 21 bp, Homo sapiens
ctccacattcctgggagattg

SEQ ID NO: 1446 - DNA, 21 bp, Homo sapiens
agatcagcacgacacgagccc

SEQ ID NO: 1447 - DNA, 21 bp, Homo sapiens
aactctgctccgcttcaagct

SEQ ID NO: 1448 - DNA, 21 bp, Homo sapiens
ggggctggagctaagtgagaa

SEQ ID NO: 1449 - DNA, 21 bp, Homo sapiens
cctctgttgacgactggcctc

SEQ ID NO: 1450 - DNA, 21 bp, Homo sapiens
gggactcctcggttcgggggg

SEQ ID NO: 1451 - DNA, 21 bp, Homo sapiens
caccccagcccctgcagctca

SEQ ID NO: 1452 - DNA, 21 bp, Homo sapiens
ttcttgggcagtggctccact

SEQ ID NO: 1453 - DNA, 21 bp, Homo sapiens
ggggctcaggaggtggcgggc

SEQ ID NO: 1454 - DNA, 21 bp, Homo sapiens
cgcctaccagtcccacctatt

SEQ ID NO: 1455 - DNA, 21 bp, Homo sapiens
tttagaagagattgaaaatca

SEQ ID NO: 1456 - DNA, 21 bp, Homo sapiens
gttccttgtcgccatctgcct

SEQ ID NO: 1457 - DNA, 21 bp, Homo sapiens
cagctttggtgccacctgcgt

SEQ ID NO: 1458 - DNA, 21 bp, Homo sapiens
gctcgggtgggaccgccgggc

SEQ ID NO: 1459 - DNA, 21 bp, Homo sapiens
agagagatttctcttcaggct

SEQ ID NO: 1460 - DNA, 21 bp, Homo sapiens
ctggactcttacatcattgaa

SEQ ID NO: 1461 - DNA, 21 bp, Homo sapiens
gcaggtttcgcatttgtaggg

SEQ ID NO: 1462 - DNA, 21 bp, Homo sapiens
cttcccatggaccttggtcat

SEQ ID NO: 1463 - DNA, 21 bp, Homo sapiens
cctacggcaagcagccctggt

SEQ ID NO: 1464 - DNA, 21 bp, Homo sapiens
cgtttgagctcagactggtcc

SEQ ID NO: 1465 - DNA, 21 bp, Homo sapiens
ctttcagcaagtggtggccta

SEQ ID NO: 1466 - DNA, 23 bp, Homo sapiens
aacagtccactaaccctgccgat

SEQ ID NO: 1467 - DNA, 21 bp, Homo sapiens
tgccagactcgtcagaaaacc

SEQ ID NO: 1468 - DNA, 21 bp, Homo sapiens
gttccacaacgtggtacgtat

SEQ ID NO: 1469 - DNA, 21 bp, Homo sapiens
ctgctgctgccgccctgagaa

SEQ ID NO: 1470 - DNA, 21 bp, Homo sapiens
tatcaaaaccgtccccaccct

SEQ ID NO: 1471 - DNA, 21 bp, Homo sapiens
cctgtgtgaacgcaccaatgg

SEQ ID NO: 1472 - DNA, 21 bp, Homo sapiens
tgtcctgaatgtgtgtgcgag

SEQ ID NO: 1473 - DNA, 21 bp, Homo sapiens
acagcttaggacatcatcata

SEQ ID NO: 1474 - DNA, 21 bp, Homo sapiens
agagtatcttcgggagacgga

SEQ ID NO: 1475 - DNA, 21 bp, Homo sapiens
caatccctcgcgtagggaatg

SEQ ID NO: 1476 - DNA, 21 bp, Homo sapiens
aacaatgaccaccatggcacc

SEQ ID NO: 1477 - DNA, 21 bp, Homo sapiens
gccagtgtccacacgatccca

SEQ ID NO: 1478 - DNA, 21 bp, Homo sapiens
ctgattttttggatgatccta

SEQ ID NO: 1479 - DNA, 21 bp, Homo sapiens
atttttttgcgtctctacttg

SEQ ID NO: 1480 - DNA, 21 bp, Homo sapiens
ccagcgtaccgccacgaaatg

SEQ ID NO: 1481 - DNA, 21 bp, Homo sapiens
gtgagtcaccgtttctgcctt

SEQ ID NO: 1482 - DNA, 21 bp, Homo sapiens
ctggtaatcgcgcccaagtca

SEQ ID NO: 1483 - DNA, 21 bp, Homo sapiens
atgggatctcgtcaaccttct

SEQ ID NO: 1484 - DNA, 21 bp, Homo sapiens
cgtcgaaagcggattccaagg

SEQ ID NO: 1485 - DNA, 21 bp, Homo sapiens
cccagcgatcgtcacaaattg

SEQ ID NO: 1486 - DNA, 21 bp, Homo sapiens
gactctgtcaggttgttgtgg

SEQ ID NO: 1487 - DNA, 21 bp, Homo sapiens
agtctgagccgtcctgactac

SEQ ID NO: 1488 - DNA, 21 bp, Homo sapiens
tctatgaaacgctcagggtgt

SEQ ID NO: 1489 - DNA, 21 bp, Homo sapiens
gcccactttgggatccacgag

SEQ ID NO: 1490 - DNA, 21 bp, Homo sapiens
gggggcttcaggaagctgcct

SEQ ID NO: 1491 - DNA, 21 bp, Homo sapiens
tgaaggctcaactactttact

SEQ ID NO: 1492 - DNA, 21 bp, Homo sapiens
tgcccgcacagggtgagtctg

SEQ ID NO: 1493 - DNA, 21 bp, Homo sapiens
ccttttgtcccttcactccat

SEQ ID NO: 1494 - DNA, 21 bp, Homo sapiens
tgattttggcgccccgttccc

SEQ ID NO: 1495 - DNA, 21 bp, Homo sapiens
atgttggcaaagcagatggac

SEQ ID NO: 1496 - DNA, 21 bp, Homo sapiens
tccccaggtcgtcagtgaggc

SEQ ID NO: 1497 - DNA, 22 bp, Homo sapiens
ggcctgggccagccgccactct

SEQ ID NO: 1498 - DNA, 21 bp, Homo sapiens
gggttgaaaatggattcgaac

SEQ ID NO: 1499 - DNA, 21 bp, Homo sapiens
ctgggtcggcgtgggcctgtg

SEQ ID NO: 1500 - DNA, 21 bp, Homo sapiens
cctctcggtatttcacaagcc

SEQ ID NO: 1501 - DNA, 21 bp, Homo sapiens
tccatctccaaagtgacagtc

SEQ ID NO: 1502 - DNA, 21 bp, Homo sapiens
cgaatactgaaaagtattttt

SEQ ID NO: 1503 - DNA, 21 bp, Homo sapiens
caccatgcttcgagaggcagt

SEQ ID NO: 1504 - DNA, 21 bp, Homo sapiens
tgtctgggactcctggcctgg

SEQ ID NO: 1505 - DNA, 21 bp, Homo sapiens
catcattaccgtggaccgtcg

SEQ ID NO: 1506 - DNA, 21 bp, Homo sapiens
agatcatcttgacagaggctg

SEQ ID NO: 1507 - DNA, 23 bp, Homo sapiens
tcggccttgccagccaccagcca

SEQ ID NO: 1508 - DNA, 21 bp, Homo sapiens
caaaaagagtccaccggagga

SEQ ID NO: 1509 - DNA, 21 bp, Homo sapiens
cttggaattcgtgagaccttt

SEQ ID NO: 1510 - DNA, 21 bp, Homo sapiens
cctatagtgttcctttagcaa

SEQ ID NO: 1511 - DNA, 21 bp, Homo sapiens
gtcaaatagtcggtattcttc

SEQ ID NO: 1512 - DNA, 21 bp, Homo sapiens
gagccctgtgcgaggccgaga

SEQ ID NO: 1513 - DNA, 21 bp, Homo sapiens
ttatccagtcgactgataccc

SEQ ID NO: 1514 - DNA, 21 bp, Homo sapiens
tggggaaccccgaaagctcat

SEQ ID NO: 1515 - DNA, 21 bp, Homo sapiens
gtgagaccgtcatcactatgt

SEQ ID NO: 1516 - DNA, 21 bp, Homo sapiens
ttaccacgtggctgagaagga

SEQ ID NO: 1517 - DNA, 21 bp, Homo sapiens
tgaaagcagtcttcaaaagag

SEQ ID NO: 1518 - DNA, 21 bp, Homo sapiens
tcgacggctcgttagccccaa

SEQ ID NO: 1519 - DNA, 21 bp, Homo sapiens
tggctcagacgctttcaactg

SEQ ID NO: 1520 - DNA, 21 bp, Homo sapiens
tgtaaggtttctctccagtat

SEQ ID NO: 1521 - DNA, 21 bp, Homo sapiens
aaaagttcacagagttacttt

SEQ ID NO: 1522 - DNA, 21 bp, Homo sapiens
gacaatggccgtcacctgctc

SEQ ID NO: 1523 - DNA, 21 bp, Homo sapiens
cccctccccctgggcagtcag

SEQ ID NO: 1524 - DNA, 21 bp, Homo sapiens
actgtgttgtcgggtgtggcc

SEQ ID NO: 1525 - DNA, 21 bp, Homo sapiens
ctgctgattgctggagtgctt

SEQ ID NO: 1526 - DNA, 21 bp, Homo sapiens
cttgctgagacgggatcttcc

SEQ ID NO: 1527 - DNA, 21 bp, Homo sapiens
ccaacgtgtagtttctatctg

SEQ ID NO: 1528 - DNA, 21 bp, Homo sapiens
tggacactgtctctaaggagc

SEQ ID NO: 1529 - DNA, 21 bp, Homo sapiens
ctccaaacccgtggaggacaa

SEQ ID NO: 1530 - DNA, 21 bp, Homo sapiens
cttggtgattgctttgttgac

SEQ ID NO: 1531 - DNA, 21 bp, Homo sapiens
gaacttctgccggccgtgggg

SEQ ID NO: 1532 - DNA, 21 bp, Homo sapiens
tgtatttgtaccaaaaagtcc

SEQ ID NO: 1533 - DNA, 23 bp, Homo sapiens
gcttgccagattgttctaccaga

SEQ ID NO: 1534 - DNA, 22 bp, Homo sapiens
tcatttctcctacccaccagcc

SEQ ID NO: 1535 - DNA, 21 bp, Homo sapiens
tgccgccagggcctgcaaatc

SEQ ID NO: 1536 - DNA, 21 bp, Homo sapiens
tctggagaaggcttgctcctg

SEQ ID NO: 1537 - DNA, 21 bp, Homo sapiens
catgggcccacgggatgccag

SEQ ID NO: 1538 - DNA, 21 bp, Homo sapiens
agcagctggcgttgaagctgc

SEQ ID NO: 1539 - DNA, 21 bp, Homo sapiens
aaagatgatcgtcataaaaac

SEQ ID NO: 1540 - DNA, 21 bp, Homo sapiens
cccaggggttgctttcttggc

SEQ ID NO: 1541 - DNA, 21 bp, Homo sapiens
gcatcgtagacgccaggagga

SEQ ID NO: 1542 - DNA, 21 bp, Homo sapiens
gtctccctcaggacaggtgat

SEQ ID NO: 1543 - DNA, 20 bp, Homo sapiens
ctccaccggcggttacagca

SEQ ID NO: 1544 - DNA, 21 bp, Homo sapiens
taatcatgacgtcataaacat

SEQ ID NO: 1545 - DNA, 21 bp, Homo sapiens
tgctggactccgtagaaaaat

SEQ ID NO: 1546 - DNA, 21 bp, Homo sapiens
gctatggatatggctgctgcc

SEQ ID NO: 1547 - DNA, 21 bp, Homo sapiens
aggacgtaccgtcaacactgt

SEQ ID NO: 1548 - DNA, 22 bp, Homo sapiens
caggtgttaatgaacaagccga

SEQ ID NO: 1549 - DNA, 21 bp, Homo sapiens
ggcttcaatcgtgacttgggc

SEQ ID NO: 1550 - DNA, 21 bp, Homo sapiens
gcgcatcaacgtgcctgtgcc

SEQ ID NO: 1551 - DNA, 21 bp, Homo sapiens
accttcttactgagtgctgct

SEQ ID NO: 1552 - DNA, 21 bp, Homo sapiens
attcattaggttgatttcagg

SEQ ID NO: 1553 - DNA, 21 bp, Homo sapiens
gtccagtgatgataggtccct

SEQ ID NO: 1554 - DNA, 21 bp, Homo sapiens
gcctgtttctcatcacactgg

SEQ ID NO: 1555 - DNA, 21 bp, Homo sapiens
gcgatgcccacttcccatgcc

SEQ ID NO: 1556 - DNA, 21 bp, Homo sapiens
attgaccgtgcgtctcagctc

SEQ ID NO: 1557 - DNA, 21 bp, Homo sapiens
cccccaaaatgttagagaact

SEQ ID NO: 1558 - DNA, 21 bp, Homo sapiens
tgacagtggtgggaaatgaaa

SEQ ID NO: 1559 - DNA, 21 bp, Homo sapiens
cagggctggacagacaaccgg

SEQ ID NO: 1560 - DNA, 21 bp, Homo sapiens
tttcaccagggcagccatggg

SEQ ID NO: 1561 - DNA, 21 bp, Homo sapiens
ggtcaagcccgaaacaaaacc

SEQ ID NO: 1562 - DNA, 21 bp, Homo sapiens
atttcttggacgcaggcactg

SEQ ID NO: 1563 - DNA, 21 bp, Homo sapiens
gggtagaagcgctgggtggtc

SEQ ID NO: 1564 - DNA, 21 bp, Homo sapiens
gcgggagaaggaggagaagga

SEQ ID NO: 1565 - DNA, 21 bp, Homo sapiens
caagactaaatccttagttca

SEQ ID NO: 1566 - DNA, 21 bp, Homo sapiens
gaaattctctgtatgatttat

SEQ ID NO: 1567 - DNA, 21 bp, Homo sapiens
ccagcggcacggcacgtcctt

SEQ ID NO: 1568 - DNA, 21 bp, Homo sapiens
atattccccagacgatctaaa

SEQ ID NO: 1569 - DNA, 21 bp, Homo sapiens
ggccgaagtagccaggcttgg

SEQ ID NO: 1570 - DNA, 21 bp, Homo sapiens
ccccttcttgtggccaatgtt

SEQ ID NO: 1571 - DNA, 21 bp, Homo sapiens
caaaagttttccagacagaat

SEQ ID NO: 1572 - DNA, 21 bp, Homo sapiens
aatgcacgtcagggtgaagcc

SEQ ID NO: 1573 - DNA, 21 bp, Homo sapiens
gagacatagccgcagactacc

SEQ ID NO: 1574 - DNA, 21 bp, Homo sapiens
gatcacacagcgcccctggta

SEQ ID NO: 1575 - DNA, 21 bp, Homo sapiens
gtggtcagccgtgaattaaga

SEQ ID NO: 1576 - DNA, 21 bp, Homo sapiens
ttatttacaaccagggagtct

SEQ ID NO: 1577 - DNA, 21 bp, Homo sapiens
tcctcacagcgcagagatgct

SEQ ID NO: 1578 - DNA, 21 bp, Homo sapiens
gggggacctcggggacccatg

SEQ ID NO: 1579 - DNA, 21 bp, Homo sapiens
ggcccgagacgaaggaggttc

SEQ ID NO: 1580 - DNA, 21 bp, Homo sapiens
ccgtatggcacgcacggtctc

SEQ ID NO: 1581 - DNA, 21 bp, Homo sapiens
gggtgatacatggtggaagag

SEQ ID NO: 1582 - DNA, 21 bp, Homo sapiens
tggttgtgacggagatatcat

SEQ ID NO: 1583 - DNA, 21 bp, Homo sapiens
ggattatgtgcgttgccattt

SEQ ID NO: 1584 - DNA, 21 bp, Homo sapiens
caggtaggcggcgtcgtcgcg

SEQ ID NO: 1585 - DNA, 21 bp, Homo sapiens
atggaggattgaggagaagta

SEQ ID NO: 1586 - DNA, 21 bp, Homo sapiens
ctgaatactattatcctaatt

SEQ ID NO: 1587 - DNA, 21 bp, Homo sapiens
gaactggtgagatggaaagtg

SEQ ID NO: 1588 - DNA, 21 bp, Homo sapiens
tgactcggccgtcagtaatac

SEQ ID NO: 1589 - DNA, 21 bp, Homo sapiens
tggtgcaggcgcaaatactgc

SEQ ID NO: 1590 - DNA, 21 bp, Homo sapiens
tggtagcggcggatctcgcga

SEQ ID NO: 1591 - DNA, 21 bp, Homo sapiens
cagcatcaacgtatggagcgt

SEQ ID NO: 1592 - DNA, 21 bp, Homo sapiens
catccatagcgtccgtgggga

SEQ ID NO: 1593 - DNA, 21 bp, Homo sapiens
aggcatttacgctgacatccc

SEQ ID NO: 1594 - DNA, 21 bp, Homo sapiens
cgccgcatgctgcccgtggac

SEQ ID NO: 1595 - DNA, 21 bp, Homo sapiens
gcgccgcatgctgcccgtgga

SEQ ID NO: 1596 - DNA, 21 bp, Homo sapiens
tgaagcgccagcggggtgacc

SEQ ID NO: 1597 - DNA, 21 bp, Homo sapiens
agattgtgtctggaagggaaa

SEQ ID NO: 1598 - DNA, 21 bp, Homo sapiens
ccctgcagacccacaaacacc

SEQ ID NO: 1599 - DNA, 21 bp, Homo sapiens
tatttcctgcgtctaacagca

SEQ ID NO: 1600 - DNA, 21 bp, Homo sapiens
ctctctggcccccagcccagg

SEQ ID NO: 1601 - DNA, 21 bp, Homo sapiens
tacagcttcccgcaggcttct

SEQ ID NO: 1602 - DNA, 21 bp, Homo sapiens
ctggtgctgttgctttggggt

SEQ ID NO: 1603 - DNA, 21 bp, Homo sapiens
cctacccctccgctggcagca

SEQ ID NO: 1604 - DNA, 21 bp, Homo sapiens
gctgtgacacctcaggtgaat

SEQ ID NO: 1605 - DNA, 21 bp, Homo sapiens
cccaacgagatgatgcgggag

SEQ ID NO: 1606 - DNA, 21 bp, Homo sapiens
gcccaacgagatgatgcggga

SEQ ID NO: 1607 - DNA, 21 bp, Homo sapiens
aaacggtccctggtgagccaa

SEQ ID NO: 1608 - DNA, 21 bp, Homo sapiens
agagttctacgaagctctcga

SEQ ID NO: 1609 - DNA, 21 bp, Homo sapiens
ccacaccatacgccagggacc

SEQ ID NO: 1610 - DNA, 21 bp, Homo sapiens
gaaactctctcgtgatgacat

SEQ ID NO: 1611 - DNA, 21 bp, Homo sapiens
acctgctggcctgctcctgcc

SEQ ID NO: 1612 - DNA, 21 bp, Homo sapiens
acagcttcctccatgatgcgg

SEQ ID NO: 1613 - DNA, 21 bp, Homo sapiens
ctgcgtgcggacccactgcat

SEQ ID NO: 1614 - DNA, 21 bp, Homo sapiens
cacaagcagcggagagtcata

SEQ ID NO: 1615 - DNA, 21 bp, Homo sapiens
acaaacttccgtctctggtgc

SEQ ID NO: 1616 - DNA, 21 bp, Homo sapiens
gacgtccaagatgcctaccac

SEQ ID NO: 1617 - DNA, 21 bp, Homo sapiens
agatcttttctgttcttttct

SEQ ID NO: 1618 - DNA, 21 bp, Homo sapiens
gagtcctgatgagagctggat

SEQ ID NO: 1619 - DNA, 21 bp, Homo sapiens
ccattggctgcgagcaggcgg

SEQ ID NO: 1620 - DNA, 21 bp, Homo sapiens
aggaatacacgaacatcttcc

SEQ ID NO: 1621 - DNA, 21 bp, Homo sapiens
cattcatgtcgtcagtcagca

SEQ ID NO: 1622 - DNA, 21 bp, Homo sapiens
gatgccacccgtctggaagcc

SEQ ID NO: 1623 - DNA, 21 bp, Homo sapiens
gatcaccgtatgcattgttcc

SEQ ID NO: 1624 - DNA, 21 bp, Homo sapiens
tacaggtcatgactgctatat

SEQ ID NO: 1625 - DNA, 21 bp, Homo sapiens
agggattgccgccaaactgct

SEQ ID NO: 1626 - DNA, 21 bp, Homo sapiens
tgctctggaattaggtgcaga

SEQ ID NO: 1627 - DNA, 21 bp, Homo sapiens
gcttagtgacgtcatttcggg

SEQ ID NO: 1628 - DNA, 21 bp, Homo sapiens
tggtcctcttcgccctggcct

SEQ ID NO: 1629 - DNA, 21 bp, Homo sapiens
cgccctaggcgtggagggcac

SEQ ID NO: 1630 - DNA, 21 bp, Homo sapiens
acatatctttcgccccttcct

SEQ ID NO: 1631 - DNA, 21 bp, Homo sapiens
tggttcgtgcgtgataatcac

SEQ ID NO: 1632 - DNA, 21 bp, Homo sapiens
gtttcagaaccgtaggatgaa

SEQ ID NO: 1633 - DNA, 21 bp, Homo sapiens
ttgatgaattagaaggcagat

SEQ ID NO: 1634 - DNA, 21 bp, Homo sapiens
ggtgaagtttaagacatcctt

SEQ ID NO: 1635 - DNA, 22 bp, Homo sapiens
gaaggtcaggcctgaagaacag

SEQ ID NO: 1636 - DNA, 22 bp, Homo sapiens
tggctgagaagcaagccacaga

SEQ ID NO: 1637 - DNA, 21 bp, Homo sapiens
cagcagagtccgcacatccag

SEQ ID NO: 1638 - DNA, 21 bp, Homo sapiens
caagctgcttacctcatcatt

SEQ ID NO: 1639 - DNA, 21 bp, Homo sapiens
aagatcggatcttaatatcaa

SEQ ID NO: 1640 - DNA, 21 bp, Homo sapiens
cgagctggggctgggacagga

SEQ ID NO: 1641 - DNA, 21 bp, Homo sapiens
gcctacgaccgttatttggcc

SEQ ID NO: 1642 - DNA, 21 bp, Homo sapiens
caaaatatgacgcaactggaa

SEQ ID NO: 1643 - DNA, 21 bp, Homo sapiens
tgagggtggcggatggctctg

SEQ ID NO: 1644 - DNA, 21 bp, Homo sapiens
tgatgaagggcgggctcccat

SEQ ID NO: 1645 - DNA, 21 bp, Homo sapiens
ttctgcccaacgacatcgatg

SEQ ID NO: 1646 - DNA, 21 bp, Homo sapiens
tctctgtcgagaacctttgta

SEQ ID NO: 1647 - DNA, 21 bp, Homo sapiens
cctggaagatcgtgtccatga

SEQ ID NO: 1648 - DNA, 21 bp, Homo sapiens
tcccttgaaccatttttgcaa

SEQ ID NO: 1649 - DNA, 21 bp, Homo sapiens
ctctgcaatcccctgttcagg

SEQ ID NO: 1650 - DNA, 21 bp, Homo sapiens
tttctgagtctctacttaaag

SEQ ID NO: 1651 - DNA, 21 bp, Homo sapiens
aagttccaaggagggtctggg

SEQ ID NO: 1652 - DNA, 21 bp, Homo sapiens
gaaatacctcgaagaaagcac

SEQ ID NO: 1653 - DNA, 21 bp, Homo sapiens
tggtagtgaactttttattct

SEQ ID NO: 1654 - DNA, 21 bp, Homo sapiens
tatcagtcaacgaccccccgg

SEQ ID NO: 1655 - DNA, 21 bp, Homo sapiens
cgtgtccaggcgctacctgtt

SEQ ID NO: 1656 - DNA, 21 bp, Homo sapiens
ttctcttaaccttcatccagt

SEQ ID NO: 1657 - DNA, 21 bp, Homo sapiens
tgacctgaaggacctgggtct

SEQ ID NO: 1658 - DNA, 22 bp, Homo sapiens
ttactggcggtagttgtaggca

SEQ ID NO: 1659 - DNA, 21 bp, Homo sapiens
ctgtgaccccggagaggtcag

SEQ ID NO: 1660 - DNA, 21 bp, Homo sapiens
caacatggaggggtcgaggtc

SEQ ID NO: 1661 - DNA, 21 bp, Homo sapiens
tctcctcggtcagctgcacgc

SEQ ID NO: 1662 - DNA, 21 bp, Homo sapiens
tgcggatttgttttgttttta

SEQ ID NO: 1663 - DNA, 21 bp, Homo sapiens
ataagcatgacgacctatgat

SEQ ID NO: 1664 - DNA, 21 bp, Homo sapiens
agctctggaaaaactttggat

SEQ ID NO: 1665 - DNA, 21 bp, Homo sapiens
tggaaagaaaccttcaaatcc

SEQ ID NO: 1666 - DNA, 21 bp, Homo sapiens
tgaccatgcacgccagcatct

SEQ ID NO: 1667 - DNA, 21 bp, Homo sapiens
agctgtgggacagggttgtgt

SEQ ID NO: 1668 - DNA, 21 bp, Homo sapiens
gacagtgatcgtcatttggca

SEQ ID NO: 1669 - DNA, 21 bp, Homo sapiens
ccttcgctttcccagactgca

SEQ ID NO: 1670 - DNA, 21 bp, Homo sapiens
agaggagggtggaaatgaagg

SEQ ID NO: 1671 - DNA, 21 bp, Homo sapiens
agtccaaatggatgcctgcaa

SEQ ID NO: 1672 - DNA, 21 bp, Homo sapiens
tgacgtacacgcgttcaggaa

SEQ ID NO: 1673 - DNA, 21 bp, Homo sapiens
acaatgcaccggatgagctca

SEQ ID NO: 1674 - DNA, 21 bp, Homo sapiens
tacccatacacgccagccacc

SEQ ID NO: 1675 - DNA, 21 bp, Homo sapiens
ttttcttttacgggcttctgg

SEQ ID NO: 1676 - DNA, 20 bp, Homo sapiens
tacaatggcaggtttatttc

SEQ ID NO: 1677 - DNA, 21 bp, Homo sapiens
ctgtcctttacgaggtaagct

SEQ ID NO: 1678 - DNA, 21 bp, Homo sapiens
accctcagtgcgatcttgctt

SEQ ID NO: 1679 - DNA, 21 bp, Homo sapiens
tctcctactatcaatattctt

SEQ ID NO: 1680 - DNA, 21 bp, Homo sapiens
tccatggaccgtaatcccact

SEQ ID NO: 1681 - DNA, 21 bp, Homo sapiens
ttcttattctgaagcaggtga

SEQ ID NO: 1682 - DNA, 21 bp, Homo sapiens
agaagaccaaggttcctagca

SEQ ID NO: 1683 - DNA, 21 bp, Homo sapiens
gactgcccgggagaacttgct

SEQ ID NO: 1684 - DNA, 21 bp, Homo sapiens
gttgtctggttgtttaacaca

SEQ ID NO: 1685 - DNA, 21 bp, Homo sapiens
ttaaccctttcgtttcttcat

SEQ ID NO: 1686 - DNA, 21 bp, Homo sapiens
gggcctgttgagaagctccaa

SEQ ID NO: 1687 - DNA, 21 bp, Homo sapiens
gcctggccccggcgaacaagc

SEQ ID NO: 1688 - DNA, 21 bp, Homo sapiens
tgttcttgcaacaaacaactg

SEQ ID NO: 1689 - DNA, 22 bp, Homo sapiens
ggcagggagaggaagccgatag

SEQ ID NO: 1690 - DNA, 21 bp, Homo sapiens
tgagtgtccatccagagtcct

SEQ ID NO: 1691 - DNA, 21 bp, Homo sapiens
gatactgaccgctggacggct

SEQ ID NO: 1692 - DNA, 21 bp, Homo sapiens
gctggcccaacgcagctacga

SEQ ID NO: 1693 - DNA, 21 bp, Homo sapiens
ctgtaatgggcaagctgtgta

SEQ ID NO: 1694 - DNA, 21 bp, Homo sapiens
ggttttattttagtgctgttc

SEQ ID NO: 1695 - DNA, 20 bp, Homo sapiens
cctttgtggcttgtgccaac

SEQ ID NO: 1696 - DNA, 21 bp, Homo sapiens
ccgcatcggtaacatcacccc

SEQ ID NO: 1697 - DNA, 21 bp, Homo sapiens
gagcgtccccggatttcgaca

SEQ ID NO: 1698 - DNA, 21 bp, Homo sapiens
agtccctcaacgagttgttgc

SEQ ID NO: 1699 - DNA, 21 bp, Homo sapiens
aagcagccttccaggatgcta

SEQ ID NO: 1700 - DNA, 21 bp, Homo sapiens
tcgaagccatcaacgaccact

SEQ ID NO: 1701 - DNA, 21 bp, Homo sapiens
ttttttgggggtgtgggaagc

SEQ ID NO: 1702 - DNA, 21 bp, Homo sapiens
aggcaagtgggacctttgtcg

SEQ ID NO: 1703 - DNA, 21 bp, Homo sapiens
acccctgtggcgacgagcaca

SEQ ID NO: 1704 - DNA, 21 bp, Homo sapiens
ggtttccccgcgctcacgttc

SEQ ID NO: 1705 - DNA, 21 bp, Homo sapiens
cctcagtatcggtcccggact

SEQ ID NO: 1706 - DNA, 21 bp, Homo sapiens
cttgggccagcgccagaactc

SEQ ID NO: 1707 - DNA, 21 bp, Homo sapiens
tacagacaaacggtttttcac

SEQ ID NO: 1708 - DNA, 21 bp, Homo sapiens
gggtcagtgcgttggtgaagg

SEQ ID NO: 1709 - DNA, 23 bp, Homo sapiens
tacaaagatcaaaccagccataa

SEQ ID NO: 1710 - DNA, 21 bp, Homo sapiens
cggaccttggcggaggccagt

SEQ ID NO: 1711 - DNA, 21 bp, Homo sapiens
attcaatttgttcctgaggcg

SEQ ID NO: 1712 - DNA, 21 bp, Homo sapiens
ttgaccaggacgaggatggct

SEQ ID NO: 1713 - DNA, 21 bp, Homo sapiens
tcccgcacccgttgagcatgt

SEQ ID NO: 1714 - DNA, 21 bp, Homo sapiens
tggctctagcatatcctttga

SEQ ID NO: 1715 - DNA, 21 bp, Homo sapiens
gggaaaaagtggtggtatacg

SEQ ID NO: 1716 - DNA, 21 bp, Homo sapiens
tcaaataagaaatttatgaaa

SEQ ID NO: 1717 - DNA, 21 bp, Homo sapiens
gggcagagagatcctgcaggt

SEQ ID NO: 1718 - DNA, 21 bp, Homo sapiens
caggcctttcgcgcacaccca

SEQ ID NO: 1719 - DNA, 21 bp, Homo sapiens
tgctccgcggcttgaactgct

SEQ ID NO: 1720 - DNA, 21 bp, Homo sapiens
ggtgtattgcatttgtcattt

SEQ ID NO: 1721 - DNA, 21 bp, Homo sapiens
agtctatcagaaccatgtaca

SEQ ID NO: 1722 - DNA, 21 bp, Homo sapiens
tctttgtgtcggccaccacca

SEQ ID NO: 1723 - DNA, 21 bp, Homo sapiens
acccggagatgctgtccgagg

SEQ ID NO: 1724 - DNA, 21 bp, Homo sapiens
ctctgtctctgaggggtccgt

SEQ ID NO: 1725 - DNA, 21 bp, Homo sapiens
atctgctctccagaaagcttt

SEQ ID NO: 1726 - DNA, 21 bp, Homo sapiens
tcccctgcccgcaggggcctc

SEQ ID NO: 1727 - DNA, 21 bp, Homo sapiens
tcgagcagtggtaaaggcttc

SEQ ID NO: 1728 - DNA, 21 bp, Homo sapiens
tcttagcaacttatctttctt

SEQ ID NO: 1729 - DNA, 21 bp, Homo sapiens
tactcattgttacttatagca

SEQ ID NO: 1730 - DNA, 21 bp, Homo sapiens
attaaacaccgtcgaattcca

SEQ ID NO: 1731 - DNA, 21 bp, Homo sapiens
tgccgcgagcgtgagaaattc

SEQ ID NO: 1732 - DNA, 21 bp, Homo sapiens
tcctgtgtccgagagagctct

SEQ ID NO: 1733 - DNA, 21 bp, Homo sapiens
tcttcataagcgggacttcat

SEQ ID NO: 1734 - DNA, 21 bp, Homo sapiens
accccactgcggatgatggta

SEQ ID NO: 1735 - DNA, 21 bp, Homo sapiens
ctgatgttcaataagacttct

SEQ ID NO: 1736 - DNA, 21 bp, Homo sapiens
attaaattaatgtggttgtta

SEQ ID NO: 1737 - DNA, 21 bp, Homo sapiens
tggatgtgaaccccgagggca

SEQ ID NO: 1738 - DNA, 21 bp, Homo sapiens
ccaccacgtaccagatggatg

SEQ ID NO: 1739 - DNA, 21 bp, Homo sapiens
atcaataacacgttgttttgt

SEQ ID NO: 1740 - DNA, 21 bp, Homo sapiens
acactggagaccacagttcat

SEQ ID NO: 1741 - DNA, 21 bp, Homo sapiens
aacttagggactgtatgctgc

SEQ ID NO: 1742 - DNA, 21 bp, Homo sapiens
ctcaccacggccacggcctcg

SEQ ID NO: 1743 - DNA, 21 bp, Homo sapiens
gggtctcctcgtcgacctccc

SEQ ID NO: 1744 - DNA, 21 bp, Homo sapiens
tttcattctacggaggctttc

SEQ ID NO: 1745 - DNA, 21 bp, Homo sapiens
ccaggtcctggccctggccct

SEQ ID NO: 1746 - DNA, 21 bp, Homo sapiens
gggaggcagatgctctgtgac

SEQ ID NO: 1747 - DNA, 21 bp, Homo sapiens
tccggaccctcgctccaaccc

SEQ ID NO: 1748 - DNA, 21 bp, Homo sapiens
gccttggcaaggtgcgtttta

SEQ ID NO: 1749 - DNA, 21 bp, Homo sapiens
cgtggtcatcgtcactggctg

SEQ ID NO: 1750 - DNA, 21 bp, Homo sapiens
caccttttcagcgtgagtata

SEQ ID NO: 1751 - DNA, 21 bp, Homo sapiens
gatggagaaacggccggtgca

SEQ ID NO: 1752 - DNA, 21 bp, Homo sapiens
actttcaaaaatagatcctcg

SEQ ID NO: 1753 - DNA, 21 bp, Homo sapiens
caacgtccccgccaccagccc

SEQ ID NO: 1754 - DNA, 21 bp, Homo sapiens
caaccagctggctgccaattc

SEQ ID NO: 1755 - DNA, 21 bp, Homo sapiens
tccagcgaatcggagagcagc

SEQ ID NO: 1756 - DNA, 21 bp, Homo sapiens
caatctaggtaacagaacttt

SEQ ID NO: 1757 - DNA, 21 bp, Homo sapiens
ttctcccctcggaagagctaa

SEQ ID NO: 1758 - DNA, 21 bp, Homo sapiens
acaatgaaggcgaccaaattc

SEQ ID NO: 1759 - DNA, 21 bp, Homo sapiens
gagggggcggcgggggcaccc

SEQ ID NO: 1760 - DNA, 21 bp, Homo sapiens
cctgacagctgctcttggtag

SEQ ID NO: 1761 - DNA, 21 bp, Homo sapiens
agtgtggcaacaggtcacttt

SEQ ID NO: 1762 - DNA, 21 bp, Homo sapiens
ggctgcggcccgagctgcgta

SEQ ID NO: 1763 - DNA, 21 bp, Homo sapiens
gctcagcagccagtgggggtg

SEQ ID NO: 1764 - DNA, 21 bp, Homo sapiens
tcatttcaccagggcagccat

SEQ ID NO: 1765 - DNA, 21 bp, Homo sapiens
gtttccattacgactcaattg

SEQ ID NO: 1766 - DNA, 21 bp, Homo sapiens
tcacagccttcttcaagtggc

SEQ ID NO: 1767 - DNA, 21 bp, Homo sapiens
cagcccccacgtctgcctggc

SEQ ID NO: 1768 - DNA, 21 bp, Homo sapiens
agatgaaataactgtatcaat

SEQ ID NO: 1769 - DNA, 21 bp, Homo sapiens
aagcaagttacgacttcagca

SEQ ID NO: 1770 - DNA, 21 bp, Homo sapiens
cagtctccttggtggtacctt

SEQ ID NO: 1771 - DNA, 21 bp, Homo sapiens
aagggttggctaacaaaaacc

SEQ ID NO: 1772 - DNA, 21 bp, Homo sapiens
tggagtcactctaatcaaatt

SEQ ID NO: 1773 - DNA, 21 bp, Homo sapiens
gatcagaagagagaagatgat

SEQ ID NO: 1774 - DNA, 21 bp, Homo sapiens
cttctaggccgtgtgcagaac

SEQ ID NO: 1775 - DNA, 21 bp, Homo sapiens
ggctggggcaaacctccagtg

SEQ ID NO: 1776 - DNA, 21 bp, Homo sapiens
ccggccaaggcgagttgctcc

SEQ ID NO: 1777 - DNA, 21 bp, Homo sapiens
acgcgcctgcgttcgcgcagt

SEQ ID NO: 1778 - DNA, 21 bp, Homo sapiens
tgtggatggccggtctctacc

SEQ ID NO: 1779 - DNA, 21 bp, Homo sapiens
tcatagatcacgggggatagg

SEQ ID NO: 1780 - DNA, 21 bp, Homo sapiens
tagccagagggtgggtctccc

SEQ ID NO: 1781 - DNA, 21 bp, Homo sapiens
agaaacctgctaactacagtg

SEQ ID NO: 1782 - DNA, 21 bp, Homo sapiens
gcaacctctcgtgtgtggaca

SEQ ID NO: 1783 - DNA, 21 bp, Homo sapiens
cgtggatgtcgttttggaagg

SEQ ID NO: 1784 - DNA, 21 bp, Homo sapiens
cttccagtgcgcccccgagat

SEQ ID NO: 1785 - DNA, 21 bp, Homo sapiens
gttgaacttccgccaagagaa

SEQ ID NO: 1786 - DNA, 21 bp, Homo sapiens
attgaaaatgtctttcttcaa

SEQ ID NO: 1787 - DNA, 21 bp, Homo sapiens
gagggactacgtcccggatca

SEQ ID NO: 1788 - DNA, 21 bp, Homo sapiens
cttcttcctgcgcaccctctc

SEQ ID NO: 1789 - DNA, 21 bp, Homo sapiens
ctatttcttcaacttctgctg

SEQ ID NO: 1790 - DNA, 21 bp, Homo sapiens
tgaatactattatcctaattt

SEQ ID NO: 1791 - DNA, 21 bp, Homo sapiens
caagagaaggcggggccctgg

SEQ ID NO: 1792 - DNA, 21 bp, Homo sapiens
cataggagacgatgccgtggg

SEQ ID NO: 1793 - DNA, 21 bp, Homo sapiens
gttcagcaaacagaccattgc

SEQ ID NO: 1794 - DNA, 21 bp, Homo sapiens
agaacgtagtgtgtgcagtgg

SEQ ID NO: 1795 - DNA, 21 bp, Homo sapiens
tgagaatgggcgccgaggggg

SEQ ID NO: 1796 - DNA, 21 bp, Homo sapiens
gagtttctgcagattgacttg

SEQ ID NO: 1797 - DNA, 21 bp, Homo sapiens
agtcctttgtctttgttctgc

SEQ ID NO: 1798 - DNA, 21 bp, Homo sapiens
ccctgttaccacagagtgtgg

SEQ ID NO: 1799 - DNA, 21 bp, Homo sapiens
agctgaatcacccacatggac

SEQ ID NO: 1800 - DNA, 21 bp, Homo sapiens
aggcggctcatagggcaccac

SEQ ID NO: 1801 - DNA, 21 bp, Homo sapiens
atctatagcataaattatgaa

SEQ ID NO: 1802 - DNA, 21 bp, Homo sapiens
ttgtggaccacaatacccgca

SEQ ID NO: 1803 - DNA, 21 bp, Homo sapiens
tgtggtgggtggctccatccc

SEQ ID NO: 1804 - DNA, 21 bp, Homo sapiens
gaagcgccagcggggtgaccc

SEQ ID NO: 1805 - DNA, 21 bp, Homo sapiens
acaagatgaggccaaacacct

SEQ ID NO: 1806 - DNA, 21 bp, Homo sapiens
catactgctgcagtccaacca

SEQ ID NO: 1807 - DNA, 21 bp, Homo sapiens
atctagacacttgttgacagc

SEQ ID NO: 1808 - DNA, 21 bp, Homo sapiens
aggtctctacttcaaccccta

SEQ ID NO: 1809 - DNA, 21 bp, Homo sapiens
tccaggaatgggtccccacaa

SEQ ID NO: 1810 - DNA, 21 bp, Homo sapiens
tcgacgttccggaattagaag

SEQ ID NO: 1811 - DNA, 21 bp, Homo sapiens
cctgctctccgcctcctccaa

SEQ ID NO: 1812 - DNA, 21 bp, Homo sapiens
cccagctcaccttggtctggt

SEQ ID NO: 1813 - DNA, 21 bp, Homo sapiens
cctcaaaagcctggtaagaag

SEQ ID NO: 1814 - DNA, 21 bp, Homo sapiens
tgttcacaggcctctgtccag

SEQ ID NO: 1815 - DNA, 21 bp, Homo sapiens
tttggagtcacagacactaag

SEQ ID NO: 1816 - DNA, 21 bp, Homo sapiens
tggatatactgtatttcagtg

SEQ ID NO: 1817 - DNA, 21 bp, Homo sapiens
gctggtgccgcgcctgttccg

SEQ ID NO: 1818 - DNA, 21 bp, Homo sapiens
catggggcctcggcagtcaat

SEQ ID NO: 1819 - DNA, 21 bp, Homo sapiens
ctactcagacccctatatcag

SEQ ID NO: 1820 - DNA, 21 bp, Homo sapiens
cactctgtaagtccttctggg

SEQ ID NO: 1821 - DNA, 21 bp, Homo sapiens
cctgctggcctgctcctgcct

SEQ ID NO: 1822 - DNA, 21 bp, Homo sapiens
ccgccagctccaggatctcgg

SEQ ID NO: 1823 - DNA, 21 bp, Homo sapiens
gcagtgttgacgcaacgcccg

SEQ ID NO: 1824 - DNA, 21 bp, Homo sapiens
tggagaggttgacgttggatt

SEQ ID NO: 1825 - DNA, 21 bp, Homo sapiens
attacaaggggctatcaagtt

SEQ ID NO: 1826 - DNA, 21 bp, Homo sapiens
ggagcagctcgcgtggtgcct

SEQ ID NO: 1827 - DNA, 21 bp, Homo sapiens
cacagaaattacagcatccaa

SEQ ID NO: 1828 - DNA, 21 bp, Homo sapiens
gagctgaaatcaagtggtgga

SEQ ID NO: 1829 - DNA, 21 bp, Homo sapiens
ccttgcaggagacgccccgat

SEQ ID NO: 1830 - DNA, 21 bp, Homo sapiens
caggtgggcacgcagcacaca

SEQ ID NO: 1831 - DNA, 21 bp, Homo sapiens
tgaccatctcgttggctgagg

SEQ ID NO: 1832 - DNA, 21 bp, Homo sapiens
gcgagacaacgagacactgcg

SEQ ID NO: 1833 - DNA, 21 bp, Homo sapiens
aactcagccttcagtagcatt

SEQ ID NO: 1834 - DNA, 21 bp, Homo sapiens
agcaccactcgtgtcctggac

SEQ ID NO: 1835 - DNA, 21 bp, Homo sapiens
cagggatgtcggagaggaatg

SEQ ID NO: 1836 - DNA, 21 bp, Homo sapiens
gtagttcagacgcacatctgc

SEQ ID NO: 1837 - DNA, 21 bp, Homo sapiens
tcggggaggacgacgaggagg

SEQ ID NO: 1838 - DNA, 21 bp, Homo sapiens
gggggcattccccatgcttcc

SEQ ID NO: 1839 - DNA, 21 bp, Homo sapiens
caagcatttgatcaaccagca

SEQ ID NO: 1840 - DNA, 21 bp, Homo sapiens
attctttgaacgcctctatgt

SEQ ID NO: 1841 - DNA, 21 bp, Homo sapiens
ttctcctgaagggaagcttat

SEQ ID NO: 1842 - DNA, 21 bp, Homo sapiens
gagctcttcttgcctgtggca

SEQ ID NO: 1843 - DNA, 21 bp, Homo sapiens
cactgcggctggcaggcactc

SEQ ID NO: 1844 - DNA, 21 bp, Homo sapiens
gaagcctgtcgcaaacactga

SEQ ID NO: 1845 - DNA, 21 bp, Homo sapiens
cagggcgacacccatcattat

SEQ ID NO: 1846 - DNA, 21 bp, Homo sapiens
gagtgaaaacgttcctagggt

SEQ ID NO: 1847 - DNA, 21 bp, Homo sapiens
acacggatagcgccgctgccc

SEQ ID NO: 1848 - DNA, 21 bp, Homo sapiens
tataccactggttctggtgct

SEQ ID NO: 1849 - DNA, 21 bp, Homo sapiens
cagctgttcaaatagttcctt

SEQ ID NO: 1850 - DNA, 21 bp, Homo sapiens
agaagtttgcgactctgacag

SEQ ID NO: 1851 - DNA, 21 bp, Homo sapiens
aaagaaacattatgctaatat

SEQ ID NO: 1852 - DNA, 21 bp, Homo sapiens
atgaagtctacgatggcatct

SEQ ID NO: 1853 - DNA, 21 bp, Homo sapiens
ctgatagggaatcccttctac

SEQ ID NO: 1854 - DNA, 21 bp, Homo sapiens
agtgggggcaggctttgcctg

SEQ ID NO: 1855 - DNA, 21 bp, Homo sapiens
agatgaaagagggcagaaact

SEQ ID NO: 1856 - DNA, 21 bp, Homo sapiens
gttttggcttaacaattttag

SEQ ID NO: 1857 - DNA, 21 bp, Homo sapiens
tgcaccgtcccgggttgcggg

SEQ ID NO: 1858 - DNA, 23 bp, Homo sapiens
aacagtccactaaccctgccgat

SEQ ID NO: 1859 - DNA, 21 bp, Homo sapiens
ttggagacgctaagccatagt

SEQ ID NO: 1860 - DNA, 22 bp, Homo sapiens
gcctcagcccagccgccatatg

SEQ ID NO: 1861 - DNA, 21 bp, Homo sapiens
ggacccttccaggcacatttc

SEQ ID NO: 1862 - DNA, 21 bp, Homo sapiens
cctctcactccggtaggccct

SEQ ID NO: 1863 - DNA, 21 bp, Homo sapiens
agaattcacacgggggaaaag

SEQ ID NO: 1864 - DNA, 21 bp, Homo sapiens
tctttgtggcgcttgccagaa

SEQ ID NO: 1865 - DNA, 21 bp, Homo sapiens
agaagatgatcaaggggtatc

SEQ ID NO: 1866 - DNA, 21 bp, Homo sapiens
cagtctacagtcagtcttatt

SEQ ID NO: 1867 - DNA, 21 bp, Homo sapiens
aacttacacaatgtatagaat

SEQ ID NO: 1868 - DNA, 21 bp, Homo sapiens
ccagggcgctgatctggctga

SEQ ID NO: 1869 - DNA, 21 bp, Homo sapiens
actcatgtgccgagcgtgcct

SEQ ID NO: 1870 - DNA, 21 bp, Homo sapiens
agatgcgtgtgggcaccatgt

SEQ ID NO: 1871 - DNA, 21 bp, Homo sapiens
tccccacagggccccgaggtg

SEQ ID NO: 1872 - DNA, 21 bp, Homo sapiens
acactgcctacctcagagcat

SEQ ID NO: 1873 - DNA, 21 bp, Homo sapiens
tactatgtgcgccacaaccag

SEQ ID NO: 1874 - DNA, 21 bp, Homo sapiens
cagagctggcgcaaagagcgg

SEQ ID NO: 1875 - DNA, 21 bp, Homo sapiens
cgctttttccggtaatgctgg

SEQ ID NO: 1876 - DNA, 21 bp, Homo sapiens
aaaatcggatcttgatcacgg

SEQ ID NO: 1877 - DNA, 21 bp, Homo sapiens
cagccgattcgctttagcccg

SEQ ID NO: 1878 - DNA, 21 bp, Homo sapiens
gtcttcaagtttacagttggg

SEQ ID NO: 1879 - DNA, 21 bp, Homo sapiens
cgttggccgcgttgctcagga

SEQ ID NO: 1880 - DNA, 21 bp, Homo sapiens
ggagaacatcgccaaggccac

SEQ ID NO: 1881 - DNA, 21 bp, Homo sapiens
gtaattacctgatgaagtcat

SEQ ID NO: 1882 - DNA, 21 bp, Homo sapiens
tctggctggcgttgtatcagg

SEQ ID NO: 1883 - DNA, 21 bp, Homo sapiens
acagccaaacaacttgaagca

SEQ ID NO: 1884 - DNA, 21 bp, Homo sapiens
ggggggcaggtcccgggacgg

SEQ ID NO: 1885 - DNA, 21 bp, Homo sapiens
tccggtgggccggatctctag

SEQ ID NO: 1886 - DNA, 21 bp, Homo sapiens
gtccagcacggtgaccactac

SEQ ID NO: 1887 - DNA, 21 bp, Homo sapiens
aatcttgcccgtcttggcagc

SEQ ID NO: 1888 - DNA, 21 bp, Homo sapiens
actttgtagcagtaatatcac

SEQ ID NO: 1889 - DNA, 21 bp, Homo sapiens
tcggattcatctatagaaggt

SEQ ID NO: 1890 - DNA, 21 bp, Homo sapiens
cgatcagatgtgcatttttcc

SEQ ID NO: 1891 - DNA, 21 bp, Homo sapiens
tgttatgatacaagttgatgt

SEQ ID NO: 1892 - DNA, 21 bp, Homo sapiens
tgcattcaacgcgacagtcct

SEQ ID NO: 1893 - DNA, 21 bp, Homo sapiens
caggggcaaagtcgggtatac

SEQ ID NO: 1894 - DNA, 21 bp, Homo sapiens
agatcatctcgtattctgggt

SEQ ID NO: 1895 - DNA, 21 bp, Homo sapiens
gtcattatcggggctatgtgg

SEQ ID NO: 1896 - DNA, 21 bp, Homo sapiens
gaggtggagggagcttctagg

SEQ ID NO: 1897 - DNA, 21 bp, Homo sapiens
ccatccttcccgagcttcaat

SEQ ID NO: 1898 - DNA, 21 bp, Homo sapiens
agggcacttgctgtagccata

SEQ ID NO: 1899 - DNA, 21 bp, Homo sapiens
ggatgctgcatggctggaact

SEQ ID NO: 1900 - DNA, 21 bp, Homo sapiens
ccactacaacattgtcaacaa

SEQ ID NO: 1901 - DNA, 20 bp, Homo sapiens
gtgagtggcaggtctttcct

SEQ ID NO: 1902 - DNA, 21 bp, Homo sapiens
gaatttatcctccttggtctg

SEQ ID NO: 1903 - DNA, 21 bp, Homo sapiens
gaaagccgccgcgtggcccag

SEQ ID NO: 1904 - DNA, 21 bp, Homo sapiens
tcagcaggcaaatctctataa

SEQ ID NO: 1905 - DNA, 21 bp, Homo sapiens
actcaaacctggggattctgc

SEQ ID NO: 1906 - DNA, 21 bp, Homo sapiens
aagacttctggaaagcagtct

SEQ ID NO: 1907 - DNA, 21 bp, Homo sapiens
cggtagttgggtagctcatag

SEQ ID NO: 1908 - DNA, 21 bp, Homo sapiens
ccattttcatctgaagacagg

SEQ ID NO: 1909 - DNA, 21 bp, Homo sapiens
tgcttccttcgtgtacctgag

SEQ ID NO: 1910 - DNA, 21 bp, Homo sapiens
cagtcatatactacttttcca

SEQ ID NO: 1911 - DNA, 21 bp, Homo sapiens
tccacagagcgtactgtctcc

SEQ ID NO: 1912 - DNA, 21 bp, Homo sapiens
ttcattgggcgagtgttcatc

SEQ ID NO: 1913 - DNA, 21 bp, Homo sapiens
cctctttcccgggggtcccag

SEQ ID NO: 1914 - DNA, 21 bp, Homo sapiens
gggtcactgcggctggcaccc

SEQ ID NO: 1915 - DNA, 21 bp, Homo sapiens
gctggattccggatgacacgc

SEQ ID NO: 1916 - DNA, 21 bp, Homo sapiens
ccatctgccacgggctgcaac

SEQ ID NO: 1917 - DNA, 21 bp, Homo sapiens
atcgccaactaaaacagcagt

SEQ ID NO: 1918 - DNA, 21 bp, Homo sapiens
tctcttgggactgttcattct

SEQ ID NO: 1919 - DNA, 21 bp, Homo sapiens
agttccctattttctgtttca

SEQ ID NO: 1920 - DNA, 21 bp, Homo sapiens
acttgggccagttggaacggg

SEQ ID NO: 1921 - DNA, 21 bp, Homo sapiens
atgaagactgacaggatggga

SEQ ID NO: 1922 - DNA, 21 bp, Homo sapiens
agagctatggcgggtttgact

SEQ ID NO: 1923 - DNA, 21 bp, Homo sapiens
gttgatgatcgagcagttggt

SEQ ID NO: 1924 - DNA, 21 bp, Homo sapiens
cgacgtggacgtttcttactt

SEQ ID NO: 1925 - DNA, 21 bp, Homo sapiens
cgcggaagcgcgacaccacca

SEQ ID NO: 1926 - DNA, 21 bp, Homo sapiens
agggcgctggccttggcaggt

SEQ ID NO: 1927 - DNA, 21 bp, Homo sapiens
aaaggggctgcgacaaagatg

SEQ ID NO: 1928 - DNA, 21 bp, Homo sapiens
gaaaactcctggggtgatctt

SEQ ID NO: 1929 - DNA, 23 bp, Homo sapiens
acacgacccagtcaagccagtaa

SEQ ID NO: 1930 - DNA, 21 bp, Homo sapiens
aagtaatgttgccagttttag

SEQ ID NO: 1931 - DNA, 21 bp, Homo sapiens
gaagactggccacatcaggcc

SEQ ID NO: 1932 - DNA, 21 bp, Homo sapiens
actcgggcagccgggtcagag

SEQ ID NO: 1933 - DNA, 21 bp, Homo sapiens
tgtgctcctcgtacagccctc

SEQ ID NO: 1934 - DNA, 21 bp, Homo sapiens
agcagccggcgtggggtgatg

SEQ ID NO: 1935 - DNA, 21 bp, Homo sapiens
cttcatggtaatgtgggcagc

SEQ ID NO: 1936 - DNA, 21 bp, Homo sapiens
taacaaatatccatgaaagag

SEQ ID NO: 1937 - DNA, 21 bp, Homo sapiens
actctttccgggttatccaaa

SEQ ID NO: 1938 - DNA, 21 bp, Homo sapiens
tccaggttccgtttacaaatg

SEQ ID NO: 1939 - DNA, 21 bp, Homo sapiens
tcccacctaccgtcgccttgc

SEQ ID NO: 1940 - DNA, 21 bp, Homo sapiens
atattcccggagtctcctgaa

SEQ ID NO: 1941 - DNA, 21 bp, Homo sapiens
ttttctggtagactcataata

SEQ ID NO: 1942 - DNA, 21 bp, Homo sapiens
gtccttggaccggatccagct

SEQ ID NO: 1943 - DNA, 21 bp, Homo sapiens
cacgcggtttttgtagccctt

SEQ ID NO: 1944 - DNA, 21 bp, Homo sapiens
actaatttacgttttatatca

SEQ ID NO: 1945 - DNA, 21 bp, Homo sapiens
atctctttaccttgataggca

SEQ ID NO: 1946 - DNA, 22 bp, Homo sapiens
cgccgtgctgtctcttcttccc

SEQ ID NO: 1947 - DNA, 20 bp, Homo sapiens
tacaatggcaggtttatttc

SEQ ID NO: 1948 - DNA, 21 bp, Homo sapiens
caagaccaaaagattaagaag

SEQ ID NO: 1949 - DNA, 21 bp, Homo sapiens
aaaagctcccgcttccaaggc

SEQ ID NO: 1950 - DNA, 21 bp, Homo sapiens
cccgactcagatgctgaggtt

SEQ ID NO: 1951 - DNA, 21 bp, Homo sapiens
gcagtatatacgcagcgggtg

SEQ ID NO: 1952 - DNA, 21 bp, Homo sapiens
aggaagctgtgtccctgacta

SEQ ID NO: 1953 - DNA, 21 bp, Homo sapiens
acctttaatatgtcccctttg

SEQ ID NO: 1954 - DNA, 21 bp, Homo sapiens
agtggcaactgggggctgctg

SEQ ID NO: 1955 - DNA, 21 bp, Homo sapiens
tcttcttttgtctttttggac

SEQ ID NO: 1956 - DNA, 21 bp, Homo sapiens
agactgctcctggtgcaggtg

SEQ ID NO: 1957 - DNA, 21 bp, Homo sapiens
gcaggatggacgtacacccct

SEQ ID NO: 1958 - DNA, 21 bp, Homo sapiens
tgtctccatagaatgctataa

SEQ ID NO: 1959 - DNA, 21 bp, Homo sapiens
ttggatcatacgtcttggcat

SEQ ID NO: 1960 - DNA, 21 bp, Homo sapiens
ccaggtcaaagatgcggatct

SEQ ID NO: 1961 - DNA, 21 bp, Homo sapiens
caatcggaagggttacatcca

SEQ ID NO: 1962 - DNA, 21 bp, Homo sapiens
aaagacgtagcgggtagccgg

SEQ ID NO: 1963 - DNA, 21 bp, Homo sapiens
gtaggaagagcgggctttcac

SEQ ID NO: 1964 - DNA, 21 bp, Homo sapiens
gatgcgcttgccgcgccgggg

SEQ ID NO: 1965 - DNA, 21 bp, Homo sapiens
aggaacctccgtgatcgattt

SEQ ID NO: 1966 - DNA, 21 bp, Homo sapiens
acatttgtagggtttctctcc

SEQ ID NO: 1967 - DNA, 21 bp, Homo sapiens
cgggagtaccgtctggataaa

SEQ ID NO: 1968 - DNA, 21 bp, Homo sapiens
aggtccagccgtttgccattc

SEQ ID NO: 1969 - DNA, 21 bp, Homo sapiens
gaaggtagctgattttggcct

SEQ ID NO: 1970 - DNA, 21 bp, Homo sapiens
gtgcaggcctctcctgggagc

SEQ ID NO: 1971 - DNA, 21 bp, Homo sapiens
gcaggtccttggaccaaccag

SEQ ID NO: 1972 - DNA, 21 bp, Homo sapiens
accgcttcaccgaggtgatca

SEQ ID NO: 1973 - DNA, 21 bp, Homo sapiens
aagtcacgaacgatggtgaaa

SEQ ID NO: 1974 - DNA, 21 bp, Homo sapiens
tgcccggcaggagtcatggga

SEQ ID NO: 1975 - DNA, 21 bp, Homo sapiens
gtggcagcagcgggcagtggt

SEQ ID NO: 1976 - DNA, 21 bp, Homo sapiens
aaaataagccgaggaacggtg

SEQ ID NO: 1977 - DNA, 21 bp, Homo sapiens
ttttccgtggcgaccatctcc

SEQ ID NO: 1978 - DNA, 21 bp, Homo sapiens
tttaggaaatacagaaactgg

SEQ ID NO: 1979 - DNA, 21 bp, Homo sapiens
caccttctctgtgtgggtccc

SEQ ID NO: 1980 - DNA, 21 bp, Homo sapiens
cacccggactcctccaccacc

SEQ ID NO: 1981 - DNA, 21 bp, Homo sapiens
cggcccagtaacagcaggctc

SEQ ID NO: 1982 - DNA, 21 bp, Homo sapiens
ccgccgtggacgaccgcgatg

SEQ ID NO: 1983 - DNA, 21 bp, Homo sapiens
gaggcgatgcactgtcgaggc

SEQ ID NO: 1984 - DNA, 21 bp, Homo sapiens
ttacataggacgcagcaatat

SEQ ID NO: 1985 - DNA, 21 bp, Homo sapiens
ctttgaactgcatcaccagga

SEQ ID NO: 1986 - DNA, 21 bp, Homo sapiens
aggattctcccttctcattag

SEQ ID NO: 1987 - DNA, 21 bp, Homo sapiens
cctcatgtttgccttctttgc

SEQ ID NO: 1988 - DNA, 21 bp, Homo sapiens
agctccccctcagtctgagtg

SEQ ID NO: 1989 - DNA, 21 bp, Homo sapiens
gcttggaaggtgagtcatgaa

SEQ ID NO: 1990 - DNA, 21 bp, Homo sapiens
agaatgaagaataacagcagc

SEQ ID NO: 1991 - DNA, 21 bp, Homo sapiens
aactcctttttcattcggtag

SEQ ID NO: 1992 - DNA, 21 bp, Homo sapiens
actaggtttcgaataaattca

SEQ ID NO: 1993 - DNA, 21 bp, Homo sapiens
cacgagaaaccgctttccttc

SEQ ID NO: 1994 - DNA, 21 bp, Homo sapiens
ccgggtgtgacgcatgatgtg

SEQ ID NO: 1995 - DNA, 21 bp, Homo sapiens
ggaaatcctttcggctctctg

SEQ ID NO: 1996 - DNA, 21 bp, Homo sapiens
ctggttacgctatatccagaa

SEQ ID NO: 1997 - DNA, 21 bp, Homo sapiens
atcatgagttcagaagaagtg

SEQ ID NO: 1998 - DNA, 21 bp, Homo sapiens
gcacctgaaacgccttcttat

SEQ ID NO: 1999 - DNA, 21 bp, Homo sapiens
tgaagatcttgaccaatggct

SEQ ID NO: 2000 - DNA, 21 bp, Homo sapiens
cgaggcattccgccaggcgtg

SEQ ID NO: 2001 - DNA, 21 bp, Homo sapiens
tgagtctgctgattcctagca

SEQ ID NO: 2002 - DNA, 21 bp, Homo sapiens
tgaatatgaacgggaagaaac

SEQ ID NO: 2003 - DNA, 21 bp, Homo sapiens
acctcaggtattacaggtatt

SEQ ID NO: 2004 - DNA, 21 bp, Homo sapiens
tgtctgcagagtgcccgtgac

SEQ ID NO: 2005 - DNA, 21 bp, Homo sapiens
tggaataggttttggactagg

SEQ ID NO: 2006 - DNA, 21 bp, Homo sapiens
ggtcatacctggaattccaat

SEQ ID NO: 2007 - DNA, 21 bp, Homo sapiens
ggccatgggggctcttggctg

SEQ ID NO: 2008 - DNA, 21 bp, Homo sapiens
cttcctcttgcgagagcaaaa

SEQ ID NO: 2009 - DNA, 21 bp, Homo sapiens
cgaagcatcattggttttagg

SEQ ID NO: 2010 - DNA, 21 bp, Homo sapiens
aatgtcatgtcgtaggtcatt

SEQ ID NO: 2011 - DNA, 21 bp, Homo sapiens
ttctccaaacgtgtctggaag

SEQ ID NO: 2012 - DNA, 21 bp, Homo sapiens
aattgacggccccaaaaacct

SEQ ID NO: 2013 - DNA, 21 bp, Homo sapiens
agtaatttcggagtttcttac

SEQ ID NO: 2014 - DNA, 21 bp, Homo sapiens
ccacctgctggcctgctcctg

SEQ ID NO: 2015 - DNA, 21 bp, Homo sapiens
acccacctgctggcctgctcc

SEQ ID NO: 2016 - DNA, 21 bp, Homo sapiens
cccacctgctggcctgctcct

SEQ ID NO: 2017 - DNA, 21 bp, Homo sapiens
aatcctccaccgtcccttgca

SEQ ID NO: 2018 - DNA, 21 bp, Homo sapiens
ctgattcagacctgcctcaac

SEQ ID NO: 2019 - DNA, 21 bp, Homo sapiens
actgctttggtgttagatttg

SEQ ID NO: 2020 - DNA, 21 bp, Homo sapiens
ggcatctggggagcctgctgg

SEQ ID NO: 2021 - DNA, 21 bp, Homo sapiens
gtccatccatctccccggtgc

SEQ ID NO: 2022 - DNA, 21 bp, Homo sapiens
tgccattattcgatttgcagt

SEQ ID NO: 2023 - DNA, 21 bp, Homo sapiens
tcaggtcccaccttgaacatg

SEQ ID NO: 2024 - DNA, 21 bp, Homo sapiens
tttggaccaattacaactggg

SEQ ID NO: 2025 - DNA, 21 bp, Homo sapiens
accatggttcatggcctgtag

SEQ ID NO: 2026 - DNA, 21 bp, Homo sapiens
acttcctggccggacctcatt

SEQ ID NO: 2027 - DNA, 21 bp, Homo sapiens
ttggatttttgcttgaagatc

SEQ ID NO: 2028 - DNA, 21 bp, Homo sapiens
gcgaggatctcggtcaggaac

SEQ ID NO: 2029 - DNA, 21 bp, Homo sapiens
acagtttcttcggtctgagac

SEQ ID NO: 2030 - DNA, 21 bp, Homo sapiens
cagccggctacgccaaaagga

SEQ ID NO: 2031 - DNA, 21 bp, Homo sapiens
gtggcctccacgcttgcctgg

SEQ ID NO: 2032 - DNA, 21 bp, Homo sapiens
tcagcatcaccagaagagtgt

SEQ ID NO: 2033 - DNA, 21 bp, Homo sapiens
ttctgctctccaatgggtacc

SEQ ID NO: 2034 - DNA, 21 bp, Homo sapiens
catccagaggcggaacgcatc

SEQ ID NO: 2035 - DNA, 21 bp, Homo sapiens
gagtatgtaatatagagaaaa

SEQ ID NO: 2036 - DNA, 21 bp, Homo sapiens
gctggtgccaggcccccatgc

SEQ ID NO: 2037 - DNA, 21 bp, Homo sapiens
aagccaaggtcctgaccatcc

SEQ ID NO: 2038 - DNA, 21 bp, Homo sapiens
ctggaagagacgcccgtggaa

SEQ ID NO: 2039 - DNA, 21 bp, Homo sapiens
tagtggaagggggtgagtctg

SEQ ID NO: 2040 - DNA, 21 bp, Homo sapiens
gtgggaagacctttagatttg

SEQ ID NO: 2041 - DNA, 21 bp, Homo sapiens
agaaagatttgactgaagaag

SEQ ID NO: 2042 - DNA, 21 bp, Homo sapiens
tcatcagtggggaattgaagg

SEQ ID NO: 2043 - DNA, 21 bp, Homo sapiens
cacaccatgacggatggcctc

SEQ ID NO: 2044 - DNA, 21 bp, Homo sapiens
acttgaagaacggagcttgaa

SEQ ID NO: 2045 - DNA, 21 bp, Homo sapiens
tggggtcggaccttggcggag

SEQ ID NO: 2046 - DNA, 21 bp, Homo sapiens
gtcgaggagggggccgccgcg

SEQ ID NO: 2047 - DNA, 21 bp, Homo sapiens
ttcagaacatcgtcatcacta

SEQ ID NO: 2048 - DNA, 21 bp, Homo sapiens
cacagcgctacgacgactgct

SEQ ID NO: 2049 - DNA, 21 bp, Homo sapiens
ttttgcaaaacgacaacagtc

SEQ ID NO: 2050 - DNA, 21 bp, Homo sapiens
ggctcttcaggtattgcagtt

SEQ ID NO: 2051 - DNA, 21 bp, Homo sapiens
cggccatcatcagataactaa

SEQ ID NO: 2052 - DNA, 21 bp, Homo sapiens
tcccacatcacggttgtcatc

SEQ ID NO: 2053 - DNA, 21 bp, Homo sapiens
cagtgaagatccttttgtaga

SEQ ID NO: 2054 - DNA, 21 bp, Homo sapiens
tgacgggagacggagtaacag

SEQ ID NO: 2055 - DNA, 21 bp, Homo sapiens
gcagcacggccgtctgccaga

SEQ ID NO: 2056 - DNA, 21 bp, Homo sapiens
tgatgaggacggtgcccacga

SEQ ID NO: 2057 - DNA, 21 bp, Homo sapiens
aagtcatccacgaagccttcc

SEQ ID NO: 2058 - DNA, 22 bp, Homo sapiens
ggcctgggccagccgccactct

SEQ ID NO: 2059 - DNA, 21 bp, Homo sapiens
tctgtgcgccggtctctccca

SEQ ID NO: 2060 - DNA, 21 bp, Homo sapiens
tggtaccagcggaggctgggt

SEQ ID NO: 2061 - DNA, 21 bp, Homo sapiens
aatatgtcatgaaccaaagaa

SEQ ID NO: 2062 - DNA, 21 bp, Homo sapiens
cgcattacaatagggcttctt

SEQ ID NO: 2063 - DNA, 21 bp, Homo sapiens
caccaggctcgttgtgagaat

SEQ ID NO: 2064 - DNA, 21 bp, Homo sapiens
gggacccttccaggcacattt

SEQ ID NO: 2065 - DNA, 21 bp, Homo sapiens
tcccgcgccaggcagcagtca

SEQ ID NO: 2066 - DNA, 21 bp, Homo sapiens
tttttcccaacgagtggccaa

SEQ ID NO: 2067 - DNA, 21 bp, Homo sapiens
atatgtccttctgcaatccca

SEQ ID NO: 2068 - DNA, 21 bp, Homo sapiens
cgattcaatcgcagaagatgt

SEQ ID NO: 2069 - DNA, 21 bp, Homo sapiens
agcttgaaaacgagaagtatg

SEQ ID NO: 2070 - DNA, 21 bp, Homo sapiens
tgagactgaacgttttccttt

SEQ ID NO: 2071 - DNA, 21 bp, Homo sapiens
ggtgggaagacgcctgggcca

SEQ ID NO: 2072 - DNA, 21 bp, Homo sapiens
gaaagattccttcgaggatat

SEQ ID NO: 2073 - DNA, 22 bp, Homo sapiens
gaaaaggaacagagactccttg

SEQ ID NO: 2074 - DNA, 21 bp, Homo sapiens
ctatggtctgtgggaaaaaaa

SEQ ID NO: 2075 - DNA, 21 bp, Homo sapiens
catataggttgcctcccacca

SEQ ID NO: 2076 - DNA, 21 bp, Homo sapiens
gctgcataccgctacgcccag

SEQ ID NO: 2077 - DNA, 21 bp, Homo sapiens
tcgtggccaccggcctgatgg

SEQ ID NO: 2078 - DNA, 21 bp, Homo sapiens
aagaagagtttttgtgtgagc

SEQ ID NO: 2079 - DNA, 21 bp, Homo sapiens
acctgcagaacgggctgccaa

SEQ ID NO: 2080 - DNA, 21 bp, Homo sapiens
gctgtccaccgtgcctgcagg

SEQ ID NO: 2081 - DNA, 21 bp, Homo sapiens
gactcaggacgttgcaatctg

SEQ ID NO: 2082 - DNA, 21 bp, Homo sapiens
gaaccatgaacgtgtcctggc

SEQ ID NO: 2083 - DNA, 21 bp, Homo sapiens
agatcatctccggtgccagag

SEQ ID NO: 2084 - DNA, 21 bp, Homo sapiens
gtcctgtccccctctcaattg

SEQ ID NO: 2085 - DNA, 21 bp, Homo sapiens
acgcgtctccgtgagcggcca

SEQ ID NO: 2086 - DNA, 21 bp, Homo sapiens
tggccacgtgcggactctttg

SEQ ID NO: 2087 - DNA, 21 bp, Homo sapiens
caggatgtttcgaaatgcatt

SEQ ID NO: 2088 - DNA, 21 bp, Homo sapiens
ccccccagtcgacccaggacc

SEQ ID NO: 2089 - DNA, 21 bp, Homo sapiens
attgcccgccgccagtggcag

SEQ ID NO: 2090 - DNA, 21 bp, Homo sapiens
gcctttggaccctggtcagtt

SEQ ID NO: 2091 - DNA, 21 bp, Homo sapiens
acgcttcatcgcctggatctc

SEQ ID NO: 2092 - DNA, 21 bp, Homo sapiens
cgcgtctgccgcccacgtaca

SEQ ID NO: 2093 - DNA, 21 bp, Homo sapiens
ttcttttagagaatccttgtt

SEQ ID NO: 2094 - DNA, 21 bp, Homo sapiens
caggagacatccaccgtcagg

SEQ ID NO: 2095 - DNA, 21 bp, Homo sapiens
cgccggtctcggggaaatgcc

SEQ ID NO: 2096 - DNA, 21 bp, Homo sapiens
aagtatagttcgaagcttttt

SEQ ID NO: 2097 - DNA, 21 bp, Homo sapiens
tgatagacaccttcatcctct

SEQ ID NO: 2098 - DNA, 21 bp, Homo sapiens
gataattattcgtgatcagag

SEQ ID NO: 2099 - DNA, 21 bp, Homo sapiens
ggacgtccgggtgagctctga

SEQ ID NO: 2100 - DNA, 21 bp, Homo sapiens
actctgcggcgcgccaggccc

SEQ ID NO: 2101 - DNA, 21 bp, Homo sapiens
caggctgttccgctcctcctc

SEQ ID NO: 2102 - DNA, 21 bp, Homo sapiens
actcacatgttctgcccactg

SEQ ID NO: 2103 - DNA, 21 bp, Homo sapiens
tcccgctcccgttcccgttcc

SEQ ID NO: 2104 - DNA, 21 bp, Homo sapiens
caagactcctccttcgacgac

SEQ ID NO: 2105 - DNA, 21 bp, Homo sapiens
gtggcagtggatgttattcct

SEQ ID NO: 2106 - DNA, 21 bp, Homo sapiens
aatgccttagttctggagttg

SEQ ID NO: 2107 - DNA, 21 bp, Homo sapiens
aaatattctcggcctggcctg

SEQ ID NO: 2108 - DNA, 21 bp, Homo sapiens
gaaccttgcacgcttgccatt

SEQ ID NO: 2109 - DNA, 21 bp, Homo sapiens
ttccactcggataagatgctg

SEQ ID NO: 2110 - DNA, 21 bp, Homo sapiens
tcacctagctccactgatgtc

SEQ ID NO: 2111 - DNA, 21 bp, Homo sapiens
atctggatcccacagcctgac

SEQ ID NO: 2112 - DNA, 21 bp, Homo sapiens
cagtccatccttaagactcac

SEQ ID NO: 2113 - DNA, 21 bp, Homo sapiens
tataatcgctcggatctttat

SEQ ID NO: 2114 - DNA, 21 bp, Homo sapiens
atccagaagtcagatttcagc

SEQ ID NO: 2115 - DNA, 21 bp, Homo sapiens
gagctctgggcgctggagggc

SEQ ID NO: 2116 - DNA, 21 bp, Homo sapiens
agaagcactacttttggcatc

SEQ ID NO: 2117 - DNA, 21 bp, Homo sapiens
gtatgctctcgtctctgccca

SEQ ID NO: 2118 - DNA, 21 bp, Homo sapiens
gccccccaacgtctgcagcat

SEQ ID NO: 2119 - DNA, 21 bp, Homo sapiens
tcctctgtggacacttcctgg

SEQ ID NO: 2120 - DNA, 21 bp, Homo sapiens
ttgaatgatacgctgtattta

SEQ ID NO: 2121 - DNA, 21 bp, Homo sapiens
ctcccgccgccgcagcagcaa

SEQ ID NO: 2122 - DNA, 21 bp, Homo sapiens
tgatccagcgcgtggtgaggg

SEQ ID NO: 2123 - DNA, 21 bp, Homo sapiens
cggtgaaggcgccgaggtcct

SEQ ID NO: 2124 - DNA, 21 bp, Homo sapiens
aaaatgacctcttttatccac

SEQ ID NO: 2125 - DNA, 21 bp, Homo sapiens
gattcaagtcgcataaagaac

SEQ ID NO: 2126 - DNA, 21 bp, Homo sapiens
gccagtggcggtaatggtctt

SEQ ID NO: 2127 - DNA, 21 bp, Homo sapiens
tggtgcagcaatgattacagc

SEQ ID NO: 2128 - DNA, 21 bp, Homo sapiens
acagaaaaataaaccaaggga

SEQ ID NO: 2129 - DNA, 21 bp, Homo sapiens
cagattcattcggtaagtttt

SEQ ID NO: 2130 - DNA, 21 bp, Homo sapiens
gaaaaagtctatcagaaccat

SEQ ID NO: 2131 - DNA, 21 bp, Homo sapiens
tacttctttcttgctggctta

SEQ ID NO: 2132 - DNA, 21 bp, Homo sapiens
aaataacatgccgaatggaat

SEQ ID NO: 2133 - DNA, 21 bp, Homo sapiens
tcctgcttccggcctgtggag

SEQ ID NO: 2134 - DNA, 21 bp, Homo sapiens
gaactttcccattcctccata

SEQ ID NO: 2135 - DNA, 21 bp, Homo sapiens
caaaagcttcatggtgttttg

SEQ ID NO: 2136 - DNA, 21 bp, Homo sapiens
acctccctccgcaccggggtg

SEQ ID NO: 2137 - DNA, 21 bp, Homo sapiens
tggtgtaggcgctgttgatgg

SEQ ID NO: 2138 - DNA, 21 bp, Homo sapiens
ccctatggccgggtgagtacg

SEQ ID NO: 2139 - DNA, 21 bp, Homo sapiens
ttggcatctcgtatgtttaca

SEQ ID NO: 2140 - DNA, 21 bp, Homo sapiens
gagcaatgtggccaggagacg

SEQ ID NO: 2141 - DNA, 21 bp, Homo sapiens
tgtatttccatgaacttatcc

SEQ ID NO: 2142 - DNA, 21 bp, Homo sapiens
tcaccgccaggtctgccattg

SEQ ID NO: 2143 - DNA, 21 bp, Homo sapiens
cggatccagcgctgtacagca

SEQ ID NO: 2144 - DNA, 21 bp, Homo sapiens
gaattctttgcccagtttgct

SEQ ID NO: 2145 - DNA, 21 bp, Homo sapiens
cctactgcgcgtatgccatca

SEQ ID NO: 2146 - DNA, 22 bp, Homo sapiens
tcagtggctgctggctctcctc

SEQ ID NO: 2147 - DNA, 21 bp, Homo sapiens
ctttctcacctttccactgca

SEQ ID NO: 2148 - DNA, 21 bp, Homo sapiens
caattgcaccgtcaggaccac

SEQ ID NO: 2149 - DNA, 21 bp, Homo sapiens
acgactcaaacgtaattcatc

SEQ ID NO: 2150 - DNA, 21 bp, Homo sapiens
ggagaaaagccattgcctcca

SEQ ID NO: 2151 - DNA, 21 bp, Homo sapiens
tggccaacaagcaggaggcac

SEQ ID NO: 2152 - DNA, 22 bp, Homo sapiens
aagggacgacgacagccacgaa

SEQ ID NO: 2153 - DNA, 21 bp, Homo sapiens
ccacgggtttcgccgaacggg

SEQ ID NO: 2154 - DNA, 21 bp, Homo sapiens
gctcgtctgcgtagcgcttgc

SEQ ID NO: 2155 - DNA, 21 bp, Homo sapiens
gcgcacctttgaaagcatcat

SEQ ID NO: 2156 - DNA, 21 bp, Homo sapiens
gcaggggggccggacacgggc

SEQ ID NO: 2157 - DNA, 21 bp, Homo sapiens
gcaggaaattcgctggccaaa

SEQ ID NO: 2158 - DNA, 21 bp, Homo sapiens
gttgagcaggttgaaggcagt

SEQ ID NO: 2159 - DNA, 21 bp, Homo sapiens
ttgggctcggcgccaggtggg

SEQ ID NO: 2160 - DNA, 21 bp, Homo sapiens
atgctgaggaggggccagacc

SEQ ID NO: 2161 - DNA, 20 bp, Homo sapiens
gtgagtggcaggtctttcct

SEQ ID NO: 2162 - DNA, 21 bp, Homo sapiens
acagacacaacgcttcaattc

SEQ ID NO: 2163 - DNA, 21 bp, Homo sapiens
aatgtcatgtcgtaggtcatt

SEQ ID NO: 2164 - DNA, 21 bp, Homo sapiens
caggtgaaacaaccttgccag

SEQ ID NO: 2165 - DNA, 21 bp, Homo sapiens
agagaaaaagggagatggcac

SEQ ID NO: 2166 - DNA, 21 bp, Homo sapiens
gaaagaagaagaaatgagaca

SEQ ID NO: 2167 - DNA, 21 bp, Homo sapiens
attggcccatccattttttgt

SEQ ID NO: 2168 - DNA, 21 bp, Homo sapiens
gtgccatcttcgaaccttcac

SEQ ID NO: 2169 - DNA, 21 bp, Homo sapiens
agtgtggcaacaggtcacttt

SEQ ID NO: 2170 - DNA, 21 bp, Homo sapiens
agccgagcctcggcccctgga

SEQ ID NO: 2171 - DNA, 21 bp, Homo sapiens
aatacataccgtgggggtcct

SEQ ID NO: 2172 - DNA, 21 bp, Homo sapiens
aagcctacaaatatatcactg

SEQ ID NO: 2173 - DNA, 21 bp, Homo sapiens
tcagtagaggcagggggaggt

SEQ ID NO: 2174 - DNA, 21 bp, Homo sapiens
acacagaaggcttttgaggta

SEQ ID NO: 2175 - DNA, 21 bp, Homo sapiens
ctgaagttcttccccaacgat

SEQ ID NO: 2176 - DNA, 21 bp, Homo sapiens
agcatgccgagtctccagacg

SEQ ID NO: 2177 - DNA, 21 bp, Homo sapiens
accctggcttcttcgacctcc

SEQ ID NO: 2178 - DNA, 21 bp, Homo sapiens
gaagcccagcgcccggatgac

SEQ ID NO: 2179 - DNA, 21 bp, Homo sapiens
tccctgtaacgtggacattgc

SEQ ID NO: 2180 - DNA, 21 bp, Homo sapiens
atcatcttctctcttctgatc

SEQ ID NO: 2181 - DNA, 21 bp, Homo sapiens
tgcctcttttcgaccccattt

SEQ ID NO: 2182 - DNA, 21 bp, Homo sapiens
tgctgtcaccgccagcacgta

SEQ ID NO: 2183 - DNA, 21 bp, Homo sapiens
gggcattgcagagaagctggg

SEQ ID NO: 2184 - DNA, 21 bp, Homo sapiens
ctcctgagggggaggattccc

SEQ ID NO: 2185 - DNA, 21 bp, Homo sapiens
ctgggccaccgtttggaaagc

SEQ ID NO: 2186 - DNA, 21 bp, Homo sapiens
gggagctggagatgtcggtga

SEQ ID NO: 2187 - DNA, 21 bp, Homo sapiens
ttcttccattcgcagtccaag

SEQ ID NO: 2188 - DNA, 21 bp, Homo sapiens
tcaacacaatcagaatgtgtg

SEQ ID NO: 2189 - DNA, 21 bp, Homo sapiens
gagtgtgcctcgataactctg

SEQ ID NO: 2190 - DNA, 21 bp, Homo sapiens
gcgtgattctgattaaatgtg

SEQ ID NO: 2191 - DNA, 21 bp, Homo sapiens
catagcttccgtggaggtgtt

SEQ ID NO: 2192 - DNA, 21 bp, Homo sapiens
gaggggcagcaacaccaccag

SEQ ID NO: 2193 - DNA, 21 bp, Homo sapiens
aattatggccgcatctccgca

SEQ ID NO: 2194 - DNA, 21 bp, Homo sapiens
gtggtgggtggctccatccct

SEQ ID NO: 2195 - DNA, 21 bp, Homo sapiens
gctactgggacgcatttttgc

SEQ ID NO: 2196 - DNA, 21 bp, Homo sapiens
gttgccaagccgaagcagcgg

SEQ ID NO: 2197 - DNA, 21 bp, Homo sapiens
tccctctacgacgtcagcaga

SEQ ID NO: 2198 - DNA, 21 bp, Homo sapiens
ctcaaccttggttaatctttg

SEQ ID NO: 2199 - DNA, 21 bp, Homo sapiens
atgctactgcgttgttagagg

SEQ ID NO: 2200 - DNA, 21 bp, Homo sapiens
gggccgaggcgttcaactctt

SEQ ID NO: 2201 - DNA, 21 bp, Homo sapiens
tggttacgctatatccagaat

SEQ ID NO: 2202 - DNA, 21 bp, Homo sapiens
gctgctggagcctctcttcct

SEQ ID NO: 2203 - DNA, 21 bp, Homo sapiens
ggaaaggacggatagtgactt

SEQ ID NO: 2204 - DNA, 21 bp, Homo sapiens
aaagctttatctacttgtgca

SEQ ID NO: 2205 - DNA, 21 bp, Homo sapiens
agtttggcggcggatacctgg

SEQ ID NO: 2206 - DNA, 21 bp, Homo sapiens
gatgtcaggcgctttgaggat

SEQ ID NO: 2207 - DNA, 21 bp, Homo sapiens
ctggcatggacgcctggtctg

SEQ ID NO: 2208 - DNA, 21 bp, Homo sapiens
ctttaccaaacgcacttgctt

SEQ ID NO: 2209 - DNA, 21 bp, Homo sapiens
gggactccacgttggtgatca

SEQ ID NO: 2210 - DNA, 21 bp, Homo sapiens
aaacagtggataccactgctt

SEQ ID NO: 2211 - DNA, 21 bp, Homo sapiens
agatttggggacatatgcatc

SEQ ID NO: 2212 - DNA, 21 bp, Homo sapiens
gagggtccttgcttgttgcag

SEQ ID NO: 2213 - DNA, 21 bp, Homo sapiens
accgactctctagtggacttc

SEQ ID NO: 2214 - DNA, 21 bp, Homo sapiens
gctccttggccaccagtgccg

SEQ ID NO: 2215 - DNA, 21 bp, Homo sapiens
gtttctcagcgtgtaaatgag

SEQ ID NO: 2216 - DNA, 21 bp, Homo sapiens
tataatatacgacaatatgag

SEQ ID NO: 2217 - DNA, 21 bp, Homo sapiens
acggtccctggtgagccaagg

SEQ ID NO: 2218 - DNA, 21 bp, Homo sapiens
tttcttcttgacttatcgttt

SEQ ID NO: 2219 - DNA, 21 bp, Homo sapiens
gcactctgtaagtccttctgg

SEQ ID NO: 2220 - DNA, 21 bp, Homo sapiens
acgccaaagacaaaggcatcc

SEQ ID NO: 2221 - DNA, 21 bp, Homo sapiens
aggtggcacaggaggcatggc

SEQ ID NO: 2222 - DNA, 21 bp, Homo sapiens
gctgcaggccgtagctgaaga

SEQ ID NO: 2223 - DNA, 21 bp, Homo sapiens
tggcagcagggcttcagttct

SEQ ID NO: 2224 - DNA, 21 bp, Homo sapiens
caatgcagtggctgtgagttt

SEQ ID NO: 2225 - DNA, 21 bp, Homo sapiens
gatcaacccggaccacagctt

SEQ ID NO: 2226 - DNA, 22 bp, Homo sapiens
catcctccatcacagcctcaga

SEQ ID NO: 2227 - DNA, 21 bp, Homo sapiens
gctttggctgcgggtggagcc

SEQ ID NO: 2228 - DNA, 21 bp, Homo sapiens
gaggaaagagtagtacagcag

SEQ ID NO: 2229 - DNA, 21 bp, Homo sapiens
catcaccttctacctcatcat

SEQ ID NO: 2230 - DNA, 21 bp, Homo sapiens
gagcggctggtgaaggaggtc

SEQ ID NO: 2231 - DNA, 21 bp, Homo sapiens
tgcaattgcaacgaatggtgt

SEQ ID NO: 2232 - DNA, 21 bp, Homo sapiens
atgaaagcaacgcccgttatt

SEQ ID NO: 2233 - DNA, 21 bp, Homo sapiens
ccagagagtaattaagttcca

SEQ ID NO: 2234 - DNA, 21 bp, Homo sapiens
accccactttcgcttcagaaa

SEQ ID NO: 2235 - DNA, 21 bp, Homo sapiens
ccaatgaaacgacttttgcca

SEQ ID NO: 2236 - DNA, 21 bp, Homo sapiens
cctcaaccaaagtgaaggaag

SEQ ID NO: 2237 - DNA, 21 bp, Homo sapiens
gacacctgcacgttctgattg

SEQ ID NO: 2238 - DNA, 21 bp, Homo sapiens
gccctgggagcgcccaccccc

SEQ ID NO: 2239 - DNA, 21 bp, Homo sapiens
acccatcagagtggccttgga

SEQ ID NO: 2240 - DNA, 21 bp, Homo sapiens
tacactaaagaatgtggaaaa

SEQ ID NO: 2241 - DNA, 21 bp, Homo sapiens
ctgggtccttgtccttgacag

SEQ ID NO: 2242 - DNA, 21 bp, Homo sapiens
catcactccctttgtagggac

SEQ ID NO: 2243 - DNA, 21 bp, Homo sapiens
catgtttgggggtggcatgtg

SEQ ID NO: 2244 - DNA, 21 bp, Homo sapiens
ggtagcttgcgtccagagtct

SEQ ID NO: 2245 - DNA, 21 bp, Homo sapiens
gctcttcacccatcgttccat

SEQ ID NO: 2246 - DNA, 21 bp, Homo sapiens
gagcgccgccgccgctggcac

SEQ ID NO: 2247 - DNA, 21 bp, Homo sapiens
aacgtatccactgaaaccgac

SEQ ID NO: 2248 - DNA, 21 bp, Homo sapiens
gattaaagtcggggggtggtg

SEQ ID NO: 2249 - DNA, 21 bp, Homo sapiens
gggccacattgtgaattttat

SEQ ID NO: 2250 - DNA, 21 bp, Homo sapiens
tcactagagtggccagctctc

SEQ ID NO: 2251 - DNA, 21 bp, Homo sapiens
tatcttctgacgcatatcagc

SEQ ID NO: 2252 - DNA, 21 bp, Homo sapiens
gcagagagccgtcccctgtgc

SEQ ID NO: 2253 - DNA, 21 bp, Homo sapiens
ttgtcagctgtttgcagggag

SEQ ID NO: 2254 - DNA, 21 bp, Homo sapiens
atttgtgccgtcttcttcatg

SEQ ID NO: 2255 - DNA, 21 bp, Homo sapiens
aacccatgcacggacgaaacc

SEQ ID NO: 2256 - DNA, 21 bp, Homo sapiens
tcattttgttgacacaaggtg

SEQ ID NO: 2257 - DNA, 21 bp, Homo sapiens
ctttcatactgtctccaaatg

SEQ ID NO: 2258 - DNA, 21 bp, Homo sapiens
ttctctgtttcctggacaggt

SEQ ID NO: 2259 - DNA, 21 bp, Homo sapiens
ccatcctcatgaatccgaaac

SEQ ID NO: 2260 - DNA, 23 bp, Homo sapiens
aatgggaggagggaagccacaaa

SEQ ID NO: 2261 - DNA, 21 bp, Homo sapiens
acaagccaaacgcaccaacac

SEQ ID NO: 2262 - DNA, 21 bp, Homo sapiens
gcgacctctcggaccgccctg

SEQ ID NO: 2263 - DNA, 21 bp, Homo sapiens
gatgtcaatactgaagaagat

SEQ ID NO: 2264 - DNA, 21 bp, Homo sapiens
cctcagaaggctgtagtgatt

SEQ ID NO: 2265 - DNA, 21 bp, Homo sapiens
ttcccatcagggtcaccacat

SEQ ID NO: 2266 - DNA, 21 bp, Homo sapiens
gccatatgataattacattcc

SEQ ID NO: 2267 - DNA, 21 bp, Homo sapiens
ccgcctgccacggcggatctc

SEQ ID NO: 2268 - DNA, 21 bp, Homo sapiens
acaacagcccggtgtttacac

SEQ ID NO: 2269 - DNA, 21 bp, Homo sapiens
agaccttccacgaggccagcg

SEQ ID NO: 2270 - DNA, 21 bp, Homo sapiens
ggtttgggctcgagggccagc

SEQ ID NO: 2271 - DNA, 21 bp, Homo sapiens
tgtttgacccggtagtaaact

SEQ ID NO: 2272 - DNA, 21 bp, Homo sapiens
gtgcttgagacgcaggtaagc

SEQ ID NO: 2273 - DNA, 21 bp, Homo sapiens
agtagctgccgtagtagctca

SEQ ID NO: 2274 - DNA, 21 bp, Homo sapiens
gatggcatgcgccgtccagca

SEQ ID NO: 2275 - DNA, 21 bp, Homo sapiens
aagctgtatagtcgatgggag

SEQ ID NO: 2276 - DNA, 21 bp, Homo sapiens
agaggagggtggaaatgaagg

SEQ ID NO: 2277 - DNA, 21 bp, Homo sapiens
cccacctcctggagcctgccc

SEQ ID NO: 2278 - DNA, 21 bp, Homo sapiens
cacacaggagaaaggccttat

SEQ ID NO: 2279 - DNA, 21 bp, Homo sapiens
agatgaagacggaaatatctt

SEQ ID NO: 2280 - DNA, 21 bp, Homo sapiens
agccaagatccgagtaccatt

SEQ ID NO: 2281 - DNA, 21 bp, Homo sapiens
agctgaggacatgaaagaagc

SEQ ID NO: 2282 - DNA, 21 bp, Homo sapiens
tacctgttacccaccactgat

SEQ ID NO: 2283 - DNA, 21 bp, Homo sapiens
tgagcaccagcaagggcgatg

SEQ ID NO: 2284 - DNA, 21 bp, Homo sapiens
cctgcaggacgcctccgccct

SEQ ID NO: 2285 - DNA, 21 bp, Homo sapiens
taaacagcaaagatgatctgc

SEQ ID NO: 2286 - DNA, 21 bp, Homo sapiens
tgaagtcctgggggctgacgc

SEQ ID NO: 2287 - DNA, 21 bp, Homo sapiens
tcgagatttcactgtagctag

SEQ ID NO: 2288 - DNA, 21 bp, Homo sapiens
gcacaggctggtggtgctggt

SEQ ID NO: 2289 - DNA, 21 bp, Homo sapiens
gtgccatctttttcctcacaa

SEQ ID NO: 2290 - DNA, 21 bp, Homo sapiens
gccacttggcgcactcctctt

SEQ ID NO: 2291 - DNA, 21 bp, Homo sapiens
aatgccatccgctacatcgag

SEQ ID NO: 2292 - DNA, 21 bp, Homo sapiens
tcccagttctcaaaggccgct

SEQ ID NO: 2293 - DNA, 21 bp, Homo sapiens
tggtgcacagggctggtccac

SEQ ID NO: 2294 - DNA, 21 bp, Homo sapiens
ccagtctgacctcagaagatc

SEQ ID NO: 2295 - DNA, 21 bp, Homo sapiens
agcctccggcgaccaggctgc

SEQ ID NO: 2296 - DNA, 21 bp, Homo sapiens
attcatttatgtctaagaaaa

SEQ ID NO: 2297 - DNA, 21 bp, Homo sapiens
ctagttaatacgtcctgccaa

SEQ ID NO: 2298 - DNA, 21 bp, Homo sapiens
ttacctgtacaccagggtgat

SEQ ID NO: 2299 - DNA, 21 bp, Homo sapiens
ggggtgatgacggaactggag

SEQ ID NO: 2300 - DNA, 21 bp, Homo sapiens
taatgctcttcagtgcttaga

SEQ ID NO: 2301 - DNA, 21 bp, Homo sapiens
gagactggcggttccatttgg

SEQ ID NO: 2302 - DNA, 21 bp, Homo sapiens
ccattgattcgtgtgaccaaa

SEQ ID NO: 2303 - DNA, 21 bp, Homo sapiens
cacttgccacctggttgcctt

SEQ ID NO: 2304 - DNA, 21 bp, Homo sapiens
aagggcgcccggcccaacatc

SEQ ID NO: 2305 - DNA, 21 bp, Homo sapiens
gagtgaggaggtccggcagtt

SEQ ID NO: 2306 - DNA, 21 bp, Homo sapiens
gtcgacgcccgcctgggtgag

SEQ ID NO: 2307 - DNA, 21 bp, Homo sapiens
tcatggttcggctttttgtgg

SEQ ID NO: 2308 - DNA, 21 bp, Homo sapiens
ctcttccagggtcctggacga

SEQ ID NO: 2309 - DNA, 21 bp, Homo sapiens
gagcgtcaggcgctggccctg

SEQ ID NO: 2310 - DNA, 20 bp, Homo sapiens
ggaatcggctgttctgctgc

SEQ ID NO: 2311 - DNA, 21 bp, Homo sapiens
cacacaatgtcgagtacagac

SEQ ID NO: 2312 - DNA, 21 bp, Homo sapiens
acctcaatgcgtttattcttg

SEQ ID NO: 2313 - DNA, 21 bp, Homo sapiens
gagcccgaaagaatgccttta

SEQ ID NO: 2314 - DNA, 21 bp, Homo sapiens
tccgccctctactctggcgtg

SEQ ID NO: 2315 - DNA, 21 bp, Homo sapiens
aagccgcctcgtgatcacgtg

SEQ ID NO: 2316 - DNA, 20 bp, Homo sapiens
aggagtggctgggttggccc

SEQ ID NO: 2317 - DNA, 21 bp, Homo sapiens
gcatttctgacgtcaccacct

SEQ ID NO: 2318 - DNA, 21 bp, Homo sapiens
cgcgctcaccggatgatcacg

SEQ ID NO: 2319 - DNA, 21 bp, Homo sapiens
agcatgattcgaaaggaaaca

SEQ ID NO: 2320 - DNA, 21 bp, Homo sapiens
gacttttaagccaattctatt

SEQ ID NO: 2321 - DNA, 21 bp, Homo sapiens
gccagtgggagggagggcacg

SEQ ID NO: 2322 - DNA, 21 bp, Homo sapiens
tgtggccgatatgctggtggc

SEQ ID NO: 2323 - DNA, 21 bp, Homo sapiens
tttccttctccgaagccagct

SEQ ID NO: 2324 - DNA, 21 bp, Homo sapiens
cctgaagcagttcaagactag

SEQ ID NO: 2325 - DNA, 21 bp, Homo sapiens
tcacaggtatcacaaaaaaag

SEQ ID NO: 2326 - DNA, 21 bp, Homo sapiens
tattttcatctgcttaatcag

SEQ ID NO: 2327 - DNA, 21 bp, Homo sapiens
ccacgggcaccgtgccaatgc

SEQ ID NO: 2328 - DNA, 21 bp, Homo sapiens
tctgtcccccgaccccaaatc

SEQ ID NO: 2329 - DNA, 21 bp, Homo sapiens
aaaacaaaaaatctaagcagc

SEQ ID NO: 2330 - DNA, 21 bp, Homo sapiens
aaaggatctggttttttctgg

SEQ ID NO: 2331 - DNA, 21 bp, Homo sapiens
gtggtgtccacgtcaacatct

SEQ ID NO: 2332 - DNA, 21 bp, Homo sapiens
gaaggacatcgtccagaccgt

SEQ ID NO: 2333 - DNA, 21 bp, Homo sapiens
cgaaacatgacgaagggctcc

SEQ ID NO: 2334 - DNA, 21 bp, Homo sapiens
atcacacctacgacctttctc

SEQ ID NO: 2335 - DNA, 21 bp, Homo sapiens
gctgcctttcggatcccttgc

SEQ ID NO: 2336 - DNA, 21 bp, Homo sapiens
ggcccaatggatttgatgaca

SEQ ID NO: 2337 - DNA, 21 bp, Homo sapiens
ttgaaaatagcgaacacaaat

SEQ ID NO: 2338 - DNA, 21 bp, Homo sapiens
cttccagctggaaactgcttt

SEQ ID NO: 2339 - DNA, 21 bp, Homo sapiens
ggtgcagcatggtgagtgccc

SEQ ID NO: 2340 - DNA, 21 bp, Homo sapiens
ctctcaactccatctacgtgg

SEQ ID NO: 2341 - DNA, 21 bp, Homo sapiens
tgcggctggtctttcggaaga

SEQ ID NO: 2342 - DNA, 21 bp, Homo sapiens
ggtacaaatcagttataactc

SEQ ID NO: 2343 - DNA, 21 bp, Homo sapiens
cgcaggcccccgctggtggag

SEQ ID NO: 2344 - DNA, 21 bp, Homo sapiens
gttgaagcatatttttattta

SEQ ID NO: 2345 - DNA, 21 bp, Homo sapiens
ccagtttttcatcgtcctgtt

SEQ ID NO: 2346 - DNA, 21 bp, Homo sapiens
ccttgcaagactgctgctcct

SEQ ID NO: 2347 - DNA, 21 bp, Homo sapiens
ctggttgtcagcatctaaaac

SEQ ID NO: 2348 - DNA, 23 bp, Homo sapiens
caagaaaaaactcaagccatagt

SEQ ID NO: 2349 - DNA, 21 bp, Homo sapiens
agtggacacctcatggggcag

SEQ ID NO: 2350 - DNA, 22 bp, Homo sapiens
taagttgtgcatcaccagccac

SEQ ID NO: 2351 - DNA, 21 bp, Homo sapiens
gtaagtcagacggaaagtgat

SEQ ID NO: 2352 - DNA, 21 bp, Homo sapiens
aagtcatctcgtttctttttg

SEQ ID NO: 2353 - DNA, 21 bp, Homo sapiens
tgacaaaacccgggacaggga

SEQ ID NO: 2354 - DNA, 21 bp, Homo sapiens
ttttacctggcaagagctgct

SEQ ID NO: 2355 - DNA, 21 bp, Homo sapiens
gaaaaaagatgacacttatga

SEQ ID NO: 2356 - DNA, 21 bp, Homo sapiens
agatacaaacagtgattccaa

SEQ ID NO: 2357 - DNA, 21 bp, Homo sapiens
cagcagtgtacgacttgcagc

SEQ ID NO: 2358 - DNA, 21 bp, Homo sapiens
catacagttactatacctttt

SEQ ID NO: 2359 - DNA, 21 bp, Homo sapiens
actgacagagataagtagaga

SEQ ID NO: 2360 - DNA, 21 bp, Homo sapiens
attggctgggagaagacggga

SEQ ID NO: 2361 - DNA, 21 bp, Homo sapiens
ctccactccctagaattctgg

SEQ ID NO: 2362 - DNA, 21 bp, Homo sapiens
ggaaataccattgttgtttac

SEQ ID NO: 2363 - DNA, 22 bp, Homo sapiens
ggcctgggccagccgccactct

SEQ ID NO: 2364 - DNA, 21 bp, Homo sapiens
gaatgtgcagcttctggatct

SEQ ID NO: 2365 - DNA, 21 bp, Homo sapiens
tcttcttccggaatggtgatt

SEQ ID NO: 2366 - DNA, 21 bp, Homo sapiens
cctgctgcacgtggccaccac

SEQ ID NO: 2367 - DNA, 21 bp, Homo sapiens
agctgctgctcctgcttctct

SEQ ID NO: 2368 - DNA, 21 bp, Homo sapiens
gacacagaatcctttatctcc

SEQ ID NO: 2369 - DNA, 21 bp, Homo sapiens
atttcactttccctagagtgc

SEQ ID NO: 2370 - DNA, 21 bp, Homo sapiens
cttatgtaccatgtcagacag

SEQ ID NO: 2371 - DNA, 21 bp, Homo sapiens
aagatgcgttcgccgttttgg

SEQ ID NO: 2372 - DNA, 21 bp, Homo sapiens
agggcccggccgttgtcttgg

SEQ ID NO: 2373 - DNA, 21 bp, Homo sapiens
gcggacgcgggtgccgggcgg

SEQ ID NO: 2374 - DNA, 21 bp, Homo sapiens
tggcttatttcaacagctgcc

SEQ ID NO: 2375 - DNA, 21 bp, Homo sapiens
tactcatcacgatggagttcc

SEQ ID NO: 2376 - DNA, 21 bp, Homo sapiens
ggcatctgggctatgatgtcc

SEQ ID NO: 2377 - DNA, 21 bp, Homo sapiens
tttttggatcgcgtcccacta

SEQ ID NO: 2378 - DNA, 21 bp, Homo sapiens
caccttagccgtctcagcttc

SEQ ID NO: 2379 - DNA, 21 bp, Homo sapiens
tgaatgcagcgcacggagcgc

SEQ ID NO: 2380 - DNA, 21 bp, Homo sapiens
ggaggcttaccaggtggacct

SEQ ID NO: 2381 - DNA, 21 bp, Homo sapiens
tgttttgaccctttcatctat

SEQ ID NO: 2382 - DNA, 21 bp, Homo sapiens
gtggggcttttagctatgaaa

SEQ ID NO: 2383 - DNA, 21 bp, Homo sapiens
atgaaagagccgatgctggga

SEQ ID NO: 2384 - DNA, 21 bp, Homo sapiens
tctggattcgctccttcctag

SEQ ID NO: 2385 - DNA, 21 bp, Homo sapiens
acaaatgtgaagaatgtggca

SEQ ID NO: 2386 - DNA, 21 bp, Homo sapiens
agccaaccttgccagcaggat

SEQ ID NO: 2387 - DNA, 21 bp, Homo sapiens
acactctggcggcagaggcgc

SEQ ID NO: 2388 - DNA, 21 bp, Homo sapiens
atagaaatggcggacacagtc

SEQ ID NO: 2389 - DNA, 21 bp, Homo sapiens
gcgcacggacgtggtcctggc

SEQ ID NO: 2390 - DNA, 21 bp, Homo sapiens
cgcggaagcgcgacaccacca

SEQ ID NO: 2391 - DNA, 21 bp, Homo sapiens
agcaaaaaaacgtcctctgaa

SEQ ID NO: 2392 - DNA, 21 bp, Homo sapiens
aacattcaacggttttccata

SEQ ID NO: 2393 - DNA, 21 bp, Homo sapiens
cgccctcgccggagcctgttg

SEQ ID NO: 2394 - DNA, 21 bp, Homo sapiens
agcttctccacggtgaatgtt

SEQ ID NO: 2395 - DNA, 21 bp, Homo sapiens
tagtttcatgtctctcatgaa

SEQ ID NO: 2396 - DNA, 21 bp, Homo sapiens
aaatgatcacgtctttaatgt

SEQ ID NO: 2397 - DNA, 21 bp, Homo sapiens
ttctggctcaatgaaggtttc

SEQ ID NO: 2398 - DNA, 21 bp, Homo sapiens
ggtctggatacgttgtaatat

SEQ ID NO: 2399 - DNA, 21 bp, Homo sapiens
ttggtagtccgtctagttggg

SEQ ID NO: 2400 - DNA, 21 bp, Homo sapiens
ccatccagcatagtgcagccg

SEQ ID NO: 2401 - DNA, 21 bp, Homo sapiens
cacgtgtacacgggtgggaag

SEQ ID NO: 2402 - DNA, 21 bp, Homo sapiens
ccgctgctcacgggcccggat

SEQ ID NO: 2403 - DNA, 21 bp, Homo sapiens
atgaattcatctttgccaggt

SEQ ID NO: 2404 - DNA, 21 bp, Homo sapiens
aataccaagacggaaaattca

SEQ ID NO: 2405 - DNA, 21 bp, Homo sapiens
tgttccggaaagtttgtcttt

SEQ ID NO: 2406 - DNA, 21 bp, Homo sapiens
gcccctcccccgaccatgttt

SEQ ID NO: 2407 - DNA, 21 bp, Homo sapiens
gctgcaccgcgttctgcactt

SEQ ID NO: 2408 - DNA, 21 bp, Homo sapiens
agaaactgtcggtgccctgca

SEQ ID NO: 2409 - DNA, 21 bp, Homo sapiens
actggcgctggccgaggttat

SEQ ID NO: 2410 - DNA, 21 bp, Homo sapiens
ctgtcctctgaatacatagag

SEQ ID NO: 2411 - DNA, 21 bp, Homo sapiens
cctgctgccacggcaatgaat

SEQ ID NO: 2412 - DNA, 21 bp, Homo sapiens
atgtcagtgtttgaaaggatt

SEQ ID NO: 2413 - DNA, 21 bp, Homo sapiens
tgaggcagaaagtccttctaa

SEQ ID NO: 2414 - DNA, 21 bp, Homo sapiens
catctcccgcgtgttgaggcg

SEQ ID NO: 2415 - DNA, 21 bp, Homo sapiens
gactgctggccgggctggggg

SEQ ID NO: 2416 - DNA, 21 bp, Homo sapiens
gtcagccaaggaggacagtat

SEQ ID NO: 2417 - DNA, 21 bp, Homo sapiens
ccaggtgtcagggggcctcag

SEQ ID NO: 2418 - DNA, 21 bp, Homo sapiens
tgcccctgttccctcacgttc

SEQ ID NO: 2419 - DNA, 21 bp, Homo sapiens
ttcttcagaaaagtgtgggcc

SEQ ID NO: 2420 - DNA, 21 bp, Homo sapiens
ggaaagatgccaagttcattt

SEQ ID NO: 2421 - DNA, 21 bp, Homo sapiens
acattcacgacgccgttgaag

SEQ ID NO: 2422 - DNA, 21 bp, Homo sapiens
gggaagtgacctcgtttgcca

SEQ ID NO: 2423 - DNA, 21 bp, Homo sapiens
ccctgtgtgccggcctgcctg

SEQ ID NO: 2424 - DNA, 21 bp, Homo sapiens
agccaaatctgctttgttttc

SEQ ID NO: 2425 - DNA, 21 bp, Homo sapiens
tgtggaccacaatacccgcac

SEQ ID NO: 2426 - DNA, 21 bp, Homo sapiens
ctgcgccgcatgctgcccgtg

SEQ ID NO: 2427 - DNA, 21 bp, Homo sapiens
ggtgaagcgccagcggggtga

SEQ ID NO: 2428 - DNA, 21 bp, Homo sapiens
ttttccaagacgcagcatgtg

SEQ ID NO: 2429 - DNA, 21 bp, Homo sapiens
aaagaaaatgagtggatggat

SEQ ID NO: 2430 - DNA, 21 bp, Homo sapiens
gtggtgctgacgaacaggttc

SEQ ID NO: 2431 - DNA, 21 bp, Homo sapiens
gtggccctctcgggctccagc

SEQ ID NO: 2432 - DNA, 21 bp, Homo sapiens
gaaatcctttcggctctctgg

SEQ ID NO: 2433 - DNA, 21 bp, Homo sapiens
atgttcccacagggaggaggt

SEQ ID NO: 2434 - DNA, 21 bp, Homo sapiens
cgccaggagcaccaagtgttg

SEQ ID NO: 2435 - DNA, 21 bp, Homo sapiens
ctggatcctgcggctgccccc

SEQ ID NO: 2436 - DNA, 21 bp, Homo sapiens
cagcgtactcgcccatgttga

SEQ ID NO: 2437 - DNA, 21 bp, Homo sapiens
cctgatctccgtggaagaatt

SEQ ID NO: 2438 - DNA, 21 bp, Homo sapiens
gtagagaatccggtctcacag

SEQ ID NO: 2439 - DNA, 21 bp, Homo sapiens
acactgtattcgttgacagag

SEQ ID NO: 2440 - DNA, 21 bp, Homo sapiens
tggagctagagacggaccgca

SEQ ID NO: 2441 - DNA, 21 bp, Homo sapiens
ggatacatgtcgttgttcaca

SEQ ID NO: 2442 - DNA, 21 bp, Homo sapiens
atgctcggatcataatcagtg

SEQ ID NO: 2443 - DNA, 21 bp, Homo sapiens
ctgaaaaaacagggcgggagt

SEQ ID NO: 2444 - DNA, 21 bp, Homo sapiens
cacacttactgctcattcttc

SEQ ID NO: 2445 - DNA, 21 bp, Homo sapiens
tgtgaagaacctagaaagagg

SEQ ID NO: 2446 - DNA, 21 bp, Homo sapiens
tgcaggatcttggcgtaggat

SEQ ID NO: 2447 - DNA, 21 bp, Homo sapiens
agccacatgtcacagcagtat

SEQ ID NO: 2448 - DNA, 21 bp, Homo sapiens
atggagatgacgccaaagata

SEQ ID NO: 2449 - DNA, 21 bp, Homo sapiens
tggcttgggtgtcaacaccaa

SEQ ID NO: 2450 - DNA, 21 bp, Homo sapiens
cctgggaagccgcccttcctg

SEQ ID NO: 2451 - DNA, 21 bp, Homo sapiens
gtggtaatgctgtttcttgga

SEQ ID NO: 2452 - DNA, 21 bp, Homo sapiens
acagtaagatcgacgccctga

SEQ ID NO: 2453 - DNA, 21 bp, Homo sapiens
agttccaatcgaagggtaggt

SEQ ID NO: 2454 - DNA, 21 bp, Homo sapiens
aaggccttcaatgaggtgatc

SEQ ID NO: 2455 - DNA, 21 bp, Homo sapiens
tttgggattcgtaggcatcac

SEQ ID NO: 2456 - DNA, 21 bp, Homo sapiens
ctcagtcaggaggtcatgttt

SEQ ID NO: 2457 - DNA, 21 bp, Homo sapiens
gctcagtcaggaggtcatgtt

SEQ ID NO: 2458 - DNA, 21 bp, Homo sapiens
ctggcatagcgcccacattct

SEQ ID NO: 2459 - DNA, 21 bp, Homo sapiens
aagcctacaaatatatcactg

SEQ ID NO: 2460 - DNA, 21 bp, Homo sapiens
ttgtagctgtcggcttggcag

SEQ ID NO: 2461 - DNA, 21 bp, Homo sapiens
ggggccaatgcaggtttcctc

SEQ ID NO: 2462 - DNA, 21 bp, Homo sapiens
agaagctcccgctgtggcagc

SEQ ID NO: 2463 - DNA, 21 bp, Homo sapiens
tgtacccaagttttaggatgc

SEQ ID NO: 2464 - DNA, 21 bp, Homo sapiens
tgaagggaacgtggcagagcg

SEQ ID NO: 2465 - DNA, 21 bp, Homo sapiens
aggagagggcgtgggggtcat

SEQ ID NO: 2466 - DNA, 21 bp, Homo sapiens
gtggggagtgtgaaggtcagc

SEQ ID NO: 2467 - DNA, 21 bp, Homo sapiens
gtttgcagacgttagtacgga

SEQ ID NO: 2468 - DNA, 21 bp, Homo sapiens
agaggagggtggaaatgaagg

SEQ ID NO: 2469 - DNA, 21 bp, Homo sapiens
ccgctctccctggggctggcg

SEQ ID NO: 2470 - DNA, 21 bp, Homo sapiens
gtcaaggcaacgcttattggc

SEQ ID NO: 2471 - DNA, 21 bp, Homo sapiens
ccccagtccccactgttggag

SEQ ID NO: 2472 - DNA, 21 bp, Homo sapiens
gttctttctcctctatattaa

SEQ ID NO: 2473 - DNA, 21 bp, Homo sapiens
gctgcatagcggtcataggcc

SEQ ID NO: 2474 - DNA, 21 bp, Homo sapiens
tcacctggcactcagacctgg

SEQ ID NO: 2475 - DNA, 21 bp, Homo sapiens
ctcagcgatgccgacatcttc

SEQ ID NO: 2476 - DNA, 21 bp, Homo sapiens
tttgtagattctgattcaact

SEQ ID NO: 2477 - DNA, 21 bp, Homo sapiens
aaagctgaatgtctccaaggc

SEQ ID NO: 2478 - DNA, 21 bp, Homo sapiens
tggaggaccttagggaagtgc

SEQ ID NO: 2479 - DNA, 21 bp, Homo sapiens
cctccaacccgccctccttct

SEQ ID NO: 2480 - DNA, 21 bp, Homo sapiens
gtgtcagctccactaattttt

SEQ ID NO: 2481 - DNA, 21 bp, Homo sapiens
ataatttttgcggcgtagact

SEQ ID NO: 2482 - DNA, 21 bp, Homo sapiens
tctctggtgccacggctttcc

SEQ ID NO: 2483 - DNA, 23 bp, Homo sapiens
ctgctgatgctgatgctgctgct

SEQ ID NO: 2484 - DNA, 21 bp, Homo sapiens
cggtctcagcgtcacccggta

SEQ ID NO: 2485 - DNA, 21 bp, Homo sapiens
ctaaaatgtaactttccatta

SEQ ID NO: 2486 - DNA, 21 bp, Homo sapiens
gcacaaacacgcacctcaaag

SEQ ID NO: 2487 - DNA, 21 bp, Homo sapiens
cggcggcgccgtgtcaggtag

SEQ ID NO: 2488 - DNA, 21 bp, Homo sapiens
ccagcacccagcctggcaggc

SEQ ID NO: 2489 - DNA, 21 bp, Homo sapiens
gctcaacttccgcttgtccac

SEQ ID NO: 2490 - DNA, 23 bp, Homo sapiens
cacaaagagaaggagaagaccaa

SEQ ID NO: 2491 - DNA, 21 bp, Homo sapiens
aacccgtgagcgggcccagcc

SEQ ID NO: 2492 - DNA, 21 bp, Homo sapiens
ctaggagatcattcttgacat

SEQ ID NO: 2493 - DNA, 21 bp, Homo sapiens
ctctacgtcaccgctaatcac

SEQ ID NO: 2494 - DNA, 21 bp, Homo sapiens
acctcactttcaaacacattt

SEQ ID NO: 2495 - DNA, 21 bp, Homo sapiens
agccacactcccttcagccaa

SEQ ID NO: 2496 - DNA, 21 bp, Homo sapiens
catcctgtttcgctgtggcat

SEQ ID NO: 2497 - DNA, 21 bp, Homo sapiens
agaagacgtcggggtgctggc

SEQ ID NO: 2498 - DNA, 21 bp, Homo sapiens
gcacattttcttgcagaacat

SEQ ID NO: 2499 - DNA, 21 bp, Homo sapiens
atactccatccgcaggaccag

SEQ ID NO: 2500 - DNA, 21 bp, Homo sapiens
ctgctccacgcggccctcgta

SEQ ID NO: 2501 - DNA, 21 bp, Homo sapiens
acacaagcaacgcagaatttg

SEQ ID NO: 2502 - DNA, 21 bp, Homo sapiens
actctctgtactcctcaagca

SEQ ID NO: 2503 - DNA, 21 bp, Homo sapiens
cttcttctttcgggtggccag

SEQ ID NO: 2504 - DNA, 21 bp, Homo sapiens
acttggcgccgtcagcactcg

SEQ ID NO: 2505 - DNA, 21 bp, Homo sapiens
cccatgacccgtgtgtatttc

SEQ ID NO: 2506 - DNA, 21 bp, Homo sapiens
atagggaatcccttctactta

SEQ ID NO: 2507 - DNA, 21 bp, Homo sapiens
agccgatcttctacaaccaga

SEQ ID NO: 2508 - DNA, 21 bp, Homo sapiens
gtggttgtccaggccatcagt

SEQ ID NO: 2509 - DNA, 21 bp, Homo sapiens
aattgatccaatgattgtcaa

SEQ ID NO: 2510 - DNA, 21 bp, Homo sapiens
atcaccacttctactgaagcc

SEQ ID NO: 2511 - DNA, 21 bp, Homo sapiens
cattacaggagccaactctgg

SEQ ID NO: 2512 - DNA, 21 bp, Homo sapiens
aattcttggcgttggttcaga

SEQ ID NO: 2513 - DNA, 21 bp, Homo sapiens
ctcagtaaagactcttcattt

SEQ ID NO: 2514 - DNA, 21 bp, Homo sapiens
gatgttttgcgtattattaaa

SEQ ID NO: 2515 - DNA, 21 bp, Homo sapiens
cttatttctcttgtagaagat

SEQ ID NO: 2516 - DNA, 21 bp, Homo sapiens
gcattccaaactatatattgg

SEQ ID NO: 2517 - DNA, 21 bp, Homo sapiens
gggaaagtaaacattgggaat

SEQ ID NO: 2518 - DNA, 20 bp, Homo sapiens
tggatctaaacctgccactg

SEQ ID NO: 2519 - DNA, 21 bp, Homo sapiens
cgaccacagcgccttcatgga

SEQ ID NO: 2520 - DNA, 21 bp, Homo sapiens
tgggtaaatacattcttcata

SEQ ID NO: 2521 - DNA, 21 bp, Homo sapiens
tttcttctttctggaaaatca

SEQ ID NO: 2522 - DNA, 21 bp, Homo sapiens
ctcattgatgggaagacattc

SEQ ID NO: 2523 - DNA, 21 bp, Homo sapiens
aggttccaccctcaagtcgaa

SEQ ID NO: 2524 - DNA, 21 bp, Homo sapiens
ttactcaagatgtgaccagag

SEQ ID NO: 2525 - DNA, 21 bp, Homo sapiens
atcggcctttcgaaacgagga

SEQ ID NO: 2526 - DNA, 21 bp, Homo sapiens
ggtttcactgtccacttctgg

SEQ ID NO: 2527 - DNA, 21 bp, Homo sapiens
gaagcgggccccaagactggc

SEQ ID NO: 2528 - DNA, 21 bp, Homo sapiens
ccgtttttccacagagagcct

SEQ ID NO: 2529 - DNA, 21 bp, Homo sapiens
ctggtgctggcgtccagaaaa

SEQ ID NO: 2530 - DNA, 21 bp, Homo sapiens
gcggccaggacgtggagcggg

SEQ ID NO: 2531 - DNA, 21 bp, Homo sapiens
tacccaaggtctgagggggga

SEQ ID NO: 2532 - DNA, 21 bp, Homo sapiens
gagctcctgacgggttacccc

SEQ ID NO: 2533 - DNA, 21 bp, Homo sapiens
cctttgtggcgcatgacaaac

SEQ ID NO: 2534 - DNA, 21 bp, Homo sapiens
gttctggctcccacgacgtag

SEQ ID NO: 2535 - DNA, 21 bp, Homo sapiens
ctgctaccccgtcgcaggcac

SEQ ID NO: 2536 - DNA, 21 bp, Homo sapiens
cctcggtacacggtggctggg

SEQ ID NO: 2537 - DNA, 21 bp, Homo sapiens
ggcccccgccgcccactgaca

SEQ ID NO: 2538 - DNA, 21 bp, Homo sapiens
atcatagacccaggagtgaag

SEQ ID NO: 2539 - DNA, 21 bp, Homo sapiens
ctgtgttcaggatttctgcct

SEQ ID NO: 2540 - DNA, 21 bp, Homo sapiens
catgccatccgcacagattca

SEQ ID NO: 2541 - DNA, 21 bp, Homo sapiens
ttttaggaaattgcgaaggga

SEQ ID NO: 2542 - DNA, 21 bp, Homo sapiens
gcaaccaaccgcatgattcca

SEQ ID NO: 2543 - DNA, 21 bp, Homo sapiens
cttccaatcaccaagtgctgg

SEQ ID NO: 2544 - DNA, 21 bp, Homo sapiens
gggagctctgcgccaagaaga

SEQ ID NO: 2545 - DNA, 21 bp, Homo sapiens
cctaattaaggtaaggctgct

SEQ ID NO: 2546 - DNA, 21 bp, Homo sapiens
tctgctggataaaaacaagcg

SEQ ID NO: 2547 - DNA, 21 bp, Homo sapiens
cgcagagcccggctacctggt

SEQ ID NO: 2548 - DNA, 21 bp, Homo sapiens
ctattggcctcggcccaggca

SEQ ID NO: 2549 - DNA, 21 bp, Homo sapiens
tctctgaatcgtcagcggtca

SEQ ID NO: 2550 - DNA, 21 bp, Homo sapiens
ctcagccaaaaagagagagca

SEQ ID NO: 2551 - DNA, 20 bp, Homo sapiens
cacggggcccgccacggtca

SEQ ID NO: 2552 - DNA, 21 bp, Homo sapiens
cttgcactttccccatttttg

SEQ ID NO: 2553 - DNA, 21 bp, Homo sapiens
cgctgaagaattggaacatag

SEQ ID NO: 2554 - DNA, 21 bp, Homo sapiens
atgctgcctggggccccccaa

SEQ ID NO: 2555 - DNA, 21 bp, Homo sapiens
cattaaccacgtcattgtact

SEQ ID NO: 2556 - DNA, 21 bp, Homo sapiens
cagaacggtcgtcttcccaat

SEQ ID NO: 2557 - DNA, 21 bp, Homo sapiens
ggtgccccccggggactcccc

SEQ ID NO: 2558 - DNA, 21 bp, Homo sapiens
gagtattggtccctgaaacac

SEQ ID NO: 2559 - DNA, 21 bp, Homo sapiens
atgaaccgtcgagcaagccag

SEQ ID NO: 2560 - DNA, 21 bp, Homo sapiens
taaactgggcgtgtcaaaggt

SEQ ID NO: 2561 - DNA, 21 bp, Homo sapiens
ggattgggttccggattgctg

SEQ ID NO: 2562 - DNA, 21 bp, Homo sapiens
gatggtcagcgtatagcaggt

SEQ ID NO: 2563 - DNA, 21 bp, Homo sapiens
tgcagcccagggtctccacgg

SEQ ID NO: 2564 - DNA, 20 bp, Homo sapiens
gagtatggccaggctgctca

SEQ ID NO: 2565 - DNA, 21 bp, Homo sapiens
agtatactgatggaaactggt

SEQ ID NO: 2566 - DNA, 22 bp, Homo sapiens
agaggctgggctgttgggcgcc

SEQ ID NO: 2567 - DNA, 21 bp, Homo sapiens
caaacttcttgggcttagaac

SEQ ID NO: 2568 - DNA, 21 bp, Homo sapiens
gcctcaggaccttgtggtgcc

SEQ ID NO: 2569 - DNA, 21 bp, Homo sapiens
cggcagaggcggccccagggc

SEQ ID NO: 2570 - DNA, 21 bp, Homo sapiens
cgcccgtgcacggtctccagc

SEQ ID NO: 2571 - DNA, 21 bp, Homo sapiens
tgctgaaactgccttacattg

SEQ ID NO: 2572 - DNA, 23 bp, Homo sapiens
ctgggggtccttgttgtccagtg

SEQ ID NO: 2573 - DNA, 21 bp, Homo sapiens
gatctttccaaaccaattggg

SEQ ID NO: 2574 - DNA, 21 bp, Homo sapiens
ggagatggcccacacagaaac

SEQ ID NO: 2575 - DNA, 21 bp, Homo sapiens
tgccctcagccaccacagccc

SEQ ID NO: 2576 - DNA, 21 bp, Homo sapiens
cacttatagacgcctctgtct

SEQ ID NO: 2577 - DNA, 21 bp, Homo sapiens
gtcataccaaccagatgaatc

SEQ ID NO: 2578 - DNA, 21 bp, Homo sapiens
cttcatctccgccatcgcgaa

SEQ ID NO: 2579 - DNA, 21 bp, Homo sapiens
ttacagttttatctgtagcat

SEQ ID NO: 2580 - DNA, 21 bp, Homo sapiens
ctcaaagattcaatcaccaaa

SEQ ID NO: 2581 - DNA, 21 bp, Homo sapiens
gagaggagggagtgctaggtg

SEQ ID NO: 2582 - DNA, 21 bp, Homo sapiens
agtagtgcacctcctcttctg

SEQ ID NO: 2583 - DNA, 20 bp, Homo sapiens
ttctgtggctggttcctctg

SEQ ID NO: 2584 - DNA, 21 bp, Homo sapiens
tcgccgcagtcggatggcagg

SEQ ID NO: 2585 - DNA, 21 bp, Homo sapiens
attatcccatagtcccactgg

SEQ ID NO: 2586 - DNA, 21 bp, Homo sapiens
ctctctctcccagacagcacg

SEQ ID NO: 2587 - DNA, 21 bp, Homo sapiens
tgtgacattcggccagaaatc

SEQ ID NO: 2588 - DNA, 21 bp, Homo sapiens
atcaaagacgagaacgacaac

SEQ ID NO: 2589 - DNA, 21 bp, Homo sapiens
gtttttcccacgagggttgtc

SEQ ID NO: 2590 - DNA, 21 bp, Homo sapiens
acttttaaacgtgaactatta

SEQ ID NO: 2591 - DNA, 21 bp, Homo sapiens
ctatagctggcgacgggagac

SEQ ID NO: 2592 - DNA, 21 bp, Homo sapiens
atatgacaataaacttcggcc

SEQ ID NO: 2593 - DNA, 21 bp, Homo sapiens
ttaattttttctgcaagggaa

SEQ ID NO: 2594 - DNA, 21 bp, Homo sapiens
gccccagtccgtgtccaaaca

SEQ ID NO: 2595 - DNA, 21 bp, Homo sapiens
catcagcgatgtgcagggaac

SEQ ID NO: 2596 - DNA, 21 bp, Homo sapiens
tcagtaacagcgcttctgtga

SEQ ID NO: 2597 - DNA, 21 bp, Homo sapiens
gtcctttcccgcaggctcctt

SEQ ID NO: 2598 - DNA, 21 bp, Homo sapiens
gccgctttgaagaggaattta

SEQ ID NO: 2599 - DNA, 21 bp, Homo sapiens
gttcttcaatttttttcaggg

SEQ ID NO: 2600 - DNA, 21 bp, Homo sapiens
gcaactaattatcattgccaa

SEQ ID NO: 2601 - DNA, 21 bp, Homo sapiens
gaagcagctgcgggagctcaa

SEQ ID NO: 2602 - DNA, 21 bp, Homo sapiens
aaagaaagccgctgaaccaag

SEQ ID NO: 2603 - DNA, 21 bp, Homo sapiens
cccaggtccacgtgaacccct

SEQ ID NO: 2604 - DNA, 21 bp, Homo sapiens
gggatcaccagcccccctctc

SEQ ID NO: 2605 - DNA, 21 bp, Homo sapiens
cagagaggccaaacaggcaga

SEQ ID NO: 2606 - DNA, 21 bp, Homo sapiens
taatgtgggcagccatgagct

SEQ ID NO: 2607 - DNA, 21 bp, Homo sapiens
tccaaggagacggcacaggta

SEQ ID NO: 2608 - DNA, 21 bp, Homo sapiens
gctgtgcgacctggagcctcg

SEQ ID NO: 2609 - DNA, 21 bp, Homo sapiens
tggtgaataacaaaggatcgg

SEQ ID NO: 2610 - DNA, 21 bp, Homo sapiens
ctgccctcagccatcggacgc

SEQ ID NO: 2611 - DNA, 21 bp, Homo sapiens
tgtatcccaacgcagtattta

SEQ ID NO: 2612 - DNA, 21 bp, Homo sapiens
gcgccagaaaactttctccac

SEQ ID NO: 2613 - DNA, 21 bp, Homo sapiens
ttgaggaattctcttggctac

SEQ ID NO: 2614 - DNA, 21 bp, Homo sapiens
ttgccactaacctatattctt

SEQ ID NO: 2615 - DNA, 21 bp, Homo sapiens
tcccatacattaaactggaag

SEQ ID NO: 2616 - DNA, 20 bp, Homo sapiens
tacaatggcaggtttatttc

SEQ ID NO: 2617 - DNA, 20 bp, Homo sapiens
ttttatggcaggagaaacag

SEQ ID NO: 2618 - DNA, 21 bp, Homo sapiens
gagaccagtacctcaagacaa

SEQ ID NO: 2619 - DNA, 21 bp, Homo sapiens
tttgcccatatatgtatcctg

SEQ ID NO: 2620 - DNA, 21 bp, Homo sapiens
ccccatcatggaccagatcaa

SEQ ID NO: 2621 - DNA, 21 bp, Homo sapiens
tgtacaccatgggtttggcca

SEQ ID NO: 2622 - DNA, 21 bp, Homo sapiens
ctgctttcccgtatccccagg

SEQ ID NO: 2623 - DNA, 21 bp, Homo sapiens
acaagtgacaccacttctggt

SEQ ID NO: 2624 - DNA, 21 bp, Homo sapiens
ggacctactagtctgtctcat

SEQ ID NO: 2625 - DNA, 21 bp, Homo sapiens
tcttcttggtcatagttggga

SEQ ID NO: 2626 - DNA, 21 bp, Homo sapiens
gcctcagagggaatactgctc

SEQ ID NO: 2627 - DNA, 21 bp, Homo sapiens
agaccggcgtccgcgatggcc

SEQ ID NO: 2628 - DNA, 21 bp, Homo sapiens
ccagctggatgagctgctaga

SEQ ID NO: 2629 - DNA, 22 bp, Homo sapiens
gaggaacacagcaagccataaa

SEQ ID NO: 2630 - DNA, 21 bp, Homo sapiens
cagctgcgatatcaacggtga

SEQ ID NO: 2631 - DNA, 21 bp, Homo sapiens
tggccccagcgtctggcagga

SEQ ID NO: 2632 - DNA, 21 bp, Homo sapiens
tccgaggggcgcccgagctgc

SEQ ID NO: 2633 - DNA, 21 bp, Homo sapiens
gggccgctacgggcccaactg

SEQ ID NO: 2634 - DNA, 21 bp, Homo sapiens
cctggaataacgccagtcttt

SEQ ID NO: 2635 - DNA, 21 bp, Homo sapiens
ggacccataacggaaactgcc

SEQ ID NO: 2636 - DNA, 21 bp, Homo sapiens
gaccctggccgcctgagtccc

SEQ ID NO: 2637 - DNA, 21 bp, Homo sapiens
tcagcatttcgcagttgttgc

SEQ ID NO: 2638 - DNA, 21 bp, Homo sapiens
agcctgttccgtctcaaacct

SEQ ID NO: 2639 - DNA, 21 bp, Homo sapiens
cactcacagcggaaggatcca

SEQ ID NO: 2640 - DNA, 21 bp, Homo sapiens
caggtcagcccggatctcagc

SEQ ID NO: 2641 - DNA, 20 bp, Homo sapiens
gaattatggcttggaaacag

SEQ ID NO: 2642 - DNA, 21 bp, Homo sapiens
gctcccccaacgccaggagaa

SEQ ID NO: 2643 - DNA, 21 bp, Homo sapiens
tgtacaaggcggatgtggcac

SEQ ID NO: 2644 - DNA, 21 bp, Homo sapiens
atggaatgttcccaaaccacc

SEQ ID NO: 2645 - DNA, 21 bp, Homo sapiens
gatgaagcctacaaatatatc

SEQ ID NO: 2646 - DNA, 21 bp, Homo sapiens
tggttgtgggagaatggctct

SEQ ID NO: 2647 - DNA, 21 bp, Homo sapiens
ctttaaaaggtgaaccaccat

SEQ ID NO: 2648 - DNA, 21 bp, Homo sapiens
cccattgccttcactggcact

SEQ ID NO: 2649 - DNA, 21 bp, Homo sapiens
agtcaccactcctttcgtggt

SEQ ID NO: 2650 - DNA, 21 bp, Homo sapiens
aagtgttggcgtcaatctcct

SEQ ID NO: 2651 - DNA, 21 bp, Homo sapiens
agcatctggcgaccctatcag

SEQ ID NO: 2652 - DNA, 21 bp, Homo sapiens
ctctgcaagcatcacgtccat

SEQ ID NO: 2653 - DNA, 21 bp, Homo sapiens
ataagcatgacgacctatgat

SEQ ID NO: 2654 - DNA, 21 bp, Homo sapiens
ttctgtggatcgaatcacatc

SEQ ID NO: 2655 - DNA, 21 bp, Homo sapiens
acacaatgtcgagtacagact

SEQ ID NO: 2656 - DNA, 21 bp, Homo sapiens
aaccgaactacgcctatggaa

SEQ ID NO: 2657 - DNA, 21 bp, Homo sapiens
gcacttctcccggacagcttt

SEQ ID NO: 2658 - DNA, 21 bp, Homo sapiens
cctgctgggcgtgggcggggt

SEQ ID NO: 2659 - DNA, 21 bp, Homo sapiens
catagagtctcccccgaagca

SEQ ID NO: 2660 - DNA, 21 bp, Homo sapiens
gctccagggcaatggcttcgg

SEQ ID NO: 2661 - DNA, 21 bp, Homo sapiens
gggcagcctacggggcaggct

SEQ ID NO: 2662 - DNA, 21 bp, Homo sapiens
ctgaaacagtaaactttgttc

SEQ ID NO: 2663 - DNA, 21 bp, Homo sapiens
ggcccatccagttacaaccag

SEQ ID NO: 2664 - DNA, 21 bp, Homo sapiens
gtcatcctaacgccagagaca

SEQ ID NO: 2665 - DNA, 21 bp, Homo sapiens
tctgccacggcgcctgctttt

SEQ ID NO: 2666 - DNA, 21 bp, Homo sapiens
tcgggggagcgtctcaaagtc

SEQ ID NO: 2667 - DNA, 21 bp, Homo sapiens
gcaaacataccttttgtttac

SEQ ID NO: 2668 - DNA, 21 bp, Homo sapiens
gtgaggcagggggagaagctt

SEQ ID NO: 2669 - DNA, 21 bp, Homo sapiens
agaccagcgcgtggagcgcct

SEQ ID NO: 2670 - DNA, 21 bp, Homo sapiens
gcaggagcagcgggaaaagcg

SEQ ID NO: 2671 - DNA, 21 bp, Homo sapiens
cgagaaattgacaaacgtatg

SEQ ID NO: 2672 - DNA, 21 bp, Homo sapiens
ttctgtctaccagcccataga

SEQ ID NO: 2673 - DNA, 21 bp, Homo sapiens
ggcactggagcgctgcaggtt

SEQ ID NO: 2674 - DNA, 21 bp, Homo sapiens
ggtctcagaagttaaggtcat

SEQ ID NO: 2675 - DNA, 21 bp, Homo sapiens
attagtcaagttccagaaaat

SEQ ID NO: 2676 - DNA, 21 bp, Homo sapiens
tgggaatatctgggtaagtca

SEQ ID NO: 2677 - DNA, 21 bp, Homo sapiens
agcgtgattctgattaaatgt

SEQ ID NO: 2678 - DNA, 21 bp, Homo sapiens
ggcacacggacgggccccact

SEQ ID NO: 2679 - DNA, 21 bp, Homo sapiens
tgacgcatacggattgccgct

SEQ ID NO: 2680 - DNA, 21 bp, Homo sapiens
catttattacactggtgctgg

SEQ ID NO: 2681 - DNA, 21 bp, Homo sapiens
ctttcaccaattgtgcctgag

SEQ ID NO: 2682 - DNA, 21 bp, Homo sapiens
agtaactctcgtactttttta

SEQ ID NO: 2683 - DNA, 21 bp, Homo sapiens
gctggccacgcgcgtaggcag

SEQ ID NO: 2684 - DNA, 21 bp, Homo sapiens
gcatttacgctgacatccctg

SEQ ID NO: 2685 - DNA, 21 bp, Homo sapiens
ctgaatttctgagactcgtaa

SEQ ID NO: 2686 - DNA, 21 bp, Homo sapiens
cgcacaggacccttccacggg

SEQ ID NO: 2687 - DNA, 21 bp, Homo sapiens
gtgaagcgccagcggggtgac

SEQ ID NO: 2688 - DNA, 21 bp, Homo sapiens
atttgctgaacccagaagaca

SEQ ID NO: 2689 - DNA, 21 bp, Homo sapiens
gttttccccacgcctgcgggg

SEQ ID NO: 2690 - DNA, 21 bp, Homo sapiens
cactgaggagcgggcagtagt

SEQ ID NO: 2691 - DNA, 21 bp, Homo sapiens
gctgagatccgctttgtcttt

SEQ ID NO: 2692 - DNA, 21 bp, Homo sapiens
gttacgctatatccagaatcg

SEQ ID NO: 2693 - DNA, 21 bp, Homo sapiens
atctcatggccctgcgcaacc

SEQ ID NO: 2694 - DNA, 21 bp, Homo sapiens
gaacaacgccgtttcagtttc

SEQ ID NO: 2695 - DNA, 21 bp, Homo sapiens
gccaggagcaccaagtgttgc

SEQ ID NO: 2696 - DNA, 21 bp, Homo sapiens
agcattcactcctatgaagaa

SEQ ID NO: 2697 - DNA, 21 bp, Homo sapiens
gattgagtttcgtagcagcag

SEQ ID NO: 2698 - DNA, 21 bp, Homo sapiens
tgaccgtggcgatattccaaa

SEQ ID NO: 2699 - DNA, 21 bp, Homo sapiens
tgctggtggccgcctcctgcc

SEQ ID NO: 2700 - DNA, 21 bp, Homo sapiens
atattgccttcggaggataca

SEQ ID NO: 2701 - DNA, 21 bp, Homo sapiens
tgcttcctctcctccttgctc

SEQ ID NO: 2702 - DNA, 21 bp, Homo sapiens
actaatatttcatattcacaa

SEQ ID NO: 2703 - DNA, 20 bp, Homo sapiens
tactaatggcttccccacat

SEQ ID NO: 2704 - DNA, 21 bp, Homo sapiens
ggcctgcttaccagccatttt

SEQ ID NO: 2705 - DNA, 21 bp, Homo sapiens
gaccctggctcctccaccaga

SEQ ID NO: 2706 - DNA, 21 bp, Homo sapiens
aataacagtcttcttcttcag

SEQ ID NO: 2707 - DNA, 21 bp, Homo sapiens
atttgcttcaccaaacttgtc

SEQ ID NO: 2708 - DNA, 21 bp, Homo sapiens
tgtccagccaccaaccagtgc

SEQ ID NO: 2709 - DNA, 21 bp, Homo sapiens
acacttaggagatacaaaaga

SEQ ID NO: 2710 - DNA, 21 bp, Homo sapiens
cagtaaggtcggaaataacca

SEQ ID NO: 2711 - DNA, 21 bp, Homo sapiens
ctgatgtccagggaaccgttg

SEQ ID NO: 2712 - DNA, 21 bp, Homo sapiens
ctcactcacccctgagccccc

SEQ ID NO: 2713 - DNA, 21 bp, Homo sapiens
ttcatgttcccgacacatttg

SEQ ID NO: 2714 - DNA, 21 bp, Homo sapiens
gtgattccagcatcaatcatt

SEQ ID NO: 2715 - DNA, 21 bp, Homo sapiens
aagcttcttcggatgttttcc

SEQ ID NO: 2716 - DNA, 21 bp, Homo sapiens
agaggaaagagtagtacagca

SEQ ID NO: 2717 - DNA, 21 bp, Homo sapiens
tcatttcaccagggcagccat

SEQ ID NO: 2718 - DNA, 21 bp, Homo sapiens
cggtccagcacgatgcattca

SEQ ID NO: 2719 - DNA, 21 bp, Homo sapiens
tgaggaaagacgacttaaaga

SEQ ID NO: 2720 - DNA, 21 bp, Homo sapiens
acagcacagcgtggtgccatt

SEQ ID NO: 2721 - DNA, 21 bp, Homo sapiens
gagtgtgggcggggctttaga

SEQ ID NO: 2722 - DNA, 21 bp, Homo sapiens
caggccacttaccttgtgggc

SEQ ID NO: 2723 - DNA, 21 bp, Homo sapiens
agaggaggatcgtatttctgc

SEQ ID NO: 2724 - DNA, 21 bp, Homo sapiens
gcaaagtggttattatgtctg

SEQ ID NO: 2725 - DNA, 21 bp, Homo sapiens
agactaaaaagcagtggactt

SEQ ID NO: 2726 - DNA, 21 bp, Homo sapiens
aggaattctgcggtcatagcg

SEQ ID NO: 2727 - DNA, 21 bp, Homo sapiens
gtaatcatgtcacgaagggta

SEQ ID NO: 2728 - DNA, 21 bp, Homo sapiens
atccagtgccgcctgccgctc

SEQ ID NO: 2729 - DNA, 21 bp, Homo sapiens
gctgaagaagcctgttgcctt

SEQ ID NO: 2730 - DNA, 21 bp, Homo sapiens
ccgagtggaagctatgctgaa

SEQ ID NO: 2731 - DNA, 21 bp, Homo sapiens
aaggccttggatggtatactg

SEQ ID NO: 2732 - DNA, 21 bp, Homo sapiens
cctcagcggccgatccacagc

SEQ ID NO: 2733 - DNA, 21 bp, Homo sapiens
accttaggctatgcagcagac

SEQ ID NO: 2734 - DNA, 21 bp, Homo sapiens
gtatggagggcggggctcctc

SEQ ID NO: 2735 - DNA, 21 bp, Homo sapiens
gtacggacccgcctggcccca

SEQ ID NO: 2736 - DNA, 21 bp, Homo sapiens
ataagcatgacgacctatgat

SEQ ID NO: 2737 - DNA, 21 bp, Homo sapiens
gaagagtctgttgttctgtgg

SEQ ID NO: 2738 - DNA, 21 bp, Homo sapiens
aattgcccaccgacaggtaag

SEQ ID NO: 2739 - DNA, 21 bp, Homo sapiens
cttgagtaactcgtaccaagc

SEQ ID NO: 2740 - DNA, 21 bp, Homo sapiens
aaaggatctagaggccaaatg

SEQ ID NO: 2741 - DNA, 21 bp, Homo sapiens
tgctgagcaggagcacctgga

SEQ ID NO: 2742 - DNA, 21 bp, Homo sapiens
catcacgatatcaggtaatta

SEQ ID NO: 2743 - DNA, 21 bp, Homo sapiens
tgagggtgccgtatggtgcca

SEQ ID NO: 2744 - DNA, 21 bp, Homo sapiens
ggaaacagttccagagtttct

SEQ ID NO: 2745 - DNA, 21 bp, Homo sapiens
tctttcctagcgcctgagaag

SEQ ID NO: 2746 - DNA, 21 bp, Homo sapiens
ttgtagtaggagatcgggtga

SEQ ID NO: 2747 - DNA, 21 bp, Homo sapiens
ctgcagagtagaagagccccg

SEQ ID NO: 2748 - DNA, 21 bp, Homo sapiens
tcaggactgcggccatagatg

SEQ ID NO: 2749 - DNA, 21 bp, Homo sapiens
ggaaggcaaggagagcctgag

SEQ ID NO: 2750 - DNA, 21 bp, Homo sapiens
ttcatcttccgttagagtttt

SEQ ID NO: 2751 - DNA, 21 bp, Homo sapiens
ttggggcgataatgatagcat

SEQ ID NO: 2752 - DNA, 21 bp, Homo sapiens
tatgtgccccgttttgtttcc

SEQ ID NO: 2753 - DNA, 21 bp, Homo sapiens
tctcaacttacctcttggccc

SEQ ID NO: 2754 - DNA, 21 bp, Homo sapiens
tttcagtacacggaaggagac

SEQ ID NO: 2755 - DNA, 21 bp, Homo sapiens
ttgtatgtggtatagagagag

SEQ ID NO: 2756 - DNA, 21 bp, Homo sapiens
tccctccaagctgccagggat

SEQ ID NO: 2757 - DNA, 21 bp, Homo sapiens
ttcactttctatttgtttaat

SEQ ID NO: 2758 - DNA, 21 bp, Homo sapiens
ttgtggcattccctgtggagg

SEQ ID NO: 2759 - DNA, 21 bp, Homo sapiens
ttcagatcatgcaggaattgc

SEQ ID NO: 2760 - DNA, 21 bp, Homo sapiens
agtgcatgtaggttatctctt

SEQ ID NO: 2761 - DNA, 21 bp, Homo sapiens
catctcttgcagtggtggggt

SEQ ID NO: 2762 - DNA, 21 bp, Homo sapiens
tggatgtaaacgacaacgctc

SEQ ID NO: 2763 - DNA, 21 bp, Homo sapiens
acaccaggggcgttggacacg

SEQ ID NO: 2764 - DNA, 21 bp, Homo sapiens
gcaagagattatgtgccattc

SEQ ID NO: 2765 - DNA, 21 bp, Homo sapiens
tggctcacccgggccatagct

SEQ ID NO: 2766 - DNA, 21 bp, Homo sapiens
gctctttgccgtacctaatat

SEQ ID NO: 2767 - DNA, 21 bp, Homo sapiens
gaatggccgcgttctggccct

SEQ ID NO: 2768 - DNA, 21 bp, Homo sapiens
ggcctcaagcggttgcacacg

SEQ ID NO: 2769 - DNA, 21 bp, Homo sapiens
catctcatccgcagtcccttc

SEQ ID NO: 2770 - DNA, 21 bp, Homo sapiens
tgccgagaagctgtgtaggaa

SEQ ID NO: 2771 - DNA, 21 bp, Homo sapiens
aagtccacatcggtcaggggt

SEQ ID NO: 2772 - DNA, 21 bp, Homo sapiens
agcttggccagtctatagagt

SEQ ID NO: 2773 - DNA, 21 bp, Homo sapiens
agcgctcatggtgggggcagc

SEQ ID NO: 2774 - DNA, 21 bp, Homo sapiens
aatcctattcagtgctccctt

SEQ ID NO: 2775 - DNA, 23 bp, Homo sapiens
ggtatggcggtttgtttactctg

SEQ ID NO: 2776 - DNA, 21 bp, Homo sapiens
ctagtcctggggctttgctct

SEQ ID NO: 2777 - DNA, 21 bp, Homo sapiens
ctgctaccctccagtgaggcc

SEQ ID NO: 2778 - DNA, 21 bp, Homo sapiens
ccatggcctacgaccgttatt

SEQ ID NO: 2779 - DNA, 21 bp, Homo sapiens
cttgtaactccatcaggtaac

SEQ ID NO: 2780 - DNA, 21 bp, Homo sapiens
aatatgccgcgcctggtgcag

SEQ ID NO: 2781 - DNA, 21 bp, Homo sapiens
gctcttcagaaaattcaagag

SEQ ID NO: 2782 - DNA, 21 bp, Homo sapiens
ggaggggctccgggaggctgc

SEQ ID NO: 2783 - DNA, 21 bp, Homo sapiens
gcttaccagcgcgacgcccag

SEQ ID NO: 2784 - DNA, 21 bp, Homo sapiens
attgcccgccgccagtggcag

SEQ ID NO: 2785 - DNA, 23 bp, Homo sapiens
tacaaagatcaaaccagccataa

SEQ ID NO: 2786 - DNA, 21 bp, Homo sapiens
tacgtctaccgcctctgcccc

SEQ ID NO: 2787 - DNA, 21 bp, Homo sapiens
acagcaaagcgggcccgtaac

SEQ ID NO: 2788 - DNA, 21 bp, Homo sapiens
tgaacatcgacggagacattg

SEQ ID NO: 2789 - DNA, 21 bp, Homo sapiens
cgaaatccacgccaatgtagc

SEQ ID NO: 2790 - DNA, 21 bp, Homo sapiens
gggccccagacggcaccagta

SEQ ID NO: 2791 - DNA, 21 bp, Homo sapiens
ccggccagtacgcccccagat

SEQ ID NO: 2792 - DNA, 22 bp, Homo sapiens
gcagagctcctgacgggttacc

SEQ ID NO: 2793 - DNA, 21 bp, Homo sapiens
aaagtcctagacaatccagac

SEQ ID NO: 2794 - DNA, 21 bp, Homo sapiens
gcgtagaaaccaaagtggcag

SEQ ID NO: 2795 - DNA, 21 bp, Homo sapiens
ctctcacaagtctccttctgg

SEQ ID NO: 2796 - DNA, 21 bp, Homo sapiens
tgtttgaaccgtcattctgct

SEQ ID NO: 2797 - DNA, 21 bp, Homo sapiens
ccacctacagcgggtcctaga

SEQ ID NO: 2798 - DNA, 21 bp, Homo sapiens
ccagcgagtcgctcacgttca

SEQ ID NO: 2799 - DNA, 21 bp, Homo sapiens
tctacatgttcttcccacatg

SEQ ID NO: 2800 - DNA, 21 bp, Homo sapiens
agctgctttccggagtagaaa

SEQ ID NO: 2801 - DNA, 21 bp, Homo sapiens
tgattcccaacggagacattg

SEQ ID NO: 2802 - DNA, 21 bp, Homo sapiens
ggtccatactccgtcttctcc

SEQ ID NO: 2803 - DNA, 21 bp, Homo sapiens
tagaagagtttgaccaggtaa

SEQ ID NO: 2804 - DNA, 21 bp, Homo sapiens
tctttctgccggatcctccaa

SEQ ID NO: 2805 - DNA, 21 bp, Homo sapiens
aggggaagggcgaagagagcc

SEQ ID NO: 2806 - DNA, 21 bp, Homo sapiens
tctccacttcgaggaactgtt

SEQ ID NO: 2807 - DNA, 21 bp, Homo sapiens
ggtggcctgacgcagcaggcc

SEQ ID NO: 2808 - DNA, 21 bp, Homo sapiens
aaatgaactcgatgccttcgt

SEQ ID NO: 2809 - DNA, 21 bp, Homo sapiens
ctcatgttttgagtaagggag

SEQ ID NO: 2810 - DNA, 21 bp, Homo sapiens
cctccaccttcggcgcagaca

SEQ ID NO: 2811 - DNA, 21 bp, Homo sapiens
ttatccatgtcgtaaatgctg

SEQ ID NO: 2812 - DNA, 21 bp, Homo sapiens
ggttccccagggcctcaggtt

SEQ ID NO: 2813 - DNA, 22 bp, Homo sapiens
tcttcatctcttgagttcaaag

SEQ ID NO: 2814 - DNA, 21 bp, Homo sapiens
tgatcttttgccatgccattg

SEQ ID NO: 2815 - DNA, 21 bp, Homo sapiens
gcctgggtaccttgtcggagc

SEQ ID NO: 2816 - DNA, 21 bp, Homo sapiens
tccactgctacgcattcctca

SEQ ID NO: 2817 - DNA, 21 bp, Homo sapiens
gggtccagagcagggtcagga

SEQ ID NO: 2818 - DNA, 21 bp, Homo sapiens
cactgggatggtgggggccct

SEQ ID NO: 2819 - DNA, 21 bp, Homo sapiens
agcgaggcaagaggaagagcg

SEQ ID NO: 2820 - DNA, 21 bp, Homo sapiens
ttcagcaggacgctggcggga

SEQ ID NO: 2821 - DNA, 21 bp, Homo sapiens
cgctggcatccgctccgggcc

SEQ ID NO: 2822 - DNA, 21 bp, Homo sapiens
ttccactctacaacttccttt

SEQ ID NO: 2823 - DNA, 21 bp, Homo sapiens
ttgggcagtgctaggaaagag

SEQ ID NO: 2824 - DNA, 21 bp, Homo sapiens
gcctcccgtcgcacacggcca

SEQ ID NO: 2825 - DNA, 21 bp, Homo sapiens
tctctccctcgctagaggcta

SEQ ID NO: 2826 - DNA, 21 bp, Homo sapiens
ctcaggaggtgacatacgcac

SEQ ID NO: 2827 - DNA, 21 bp, Homo sapiens
actggtgaccccgctctcggg

SEQ ID NO: 2828 - DNA, 21 bp, Homo sapiens
gccagactgtcggcctccaga

SEQ ID NO: 2829 - DNA, 21 bp, Homo sapiens
gggagggcgcggagccccttg

SEQ ID NO: 2830 - DNA, 22 bp, Homo sapiens
tggctggcggctgaagtggcca

SEQ ID NO: 2831 - DNA, 21 bp, Homo sapiens
actggctttcctgctcccgat

SEQ ID NO: 2832 - DNA, 21 bp, Homo sapiens
cccagtataacaagtacaggg

SEQ ID NO: 2833 - DNA, 21 bp, Homo sapiens
tgaggttttcgttgtagcgga

SEQ ID NO: 2834 - DNA, 21 bp, Homo sapiens
taaatccattcacatcagcag

SEQ ID NO: 2835 - DNA, 21 bp, Homo sapiens
acttcggggttcccttggccc

SEQ ID NO: 2836 - DNA, 21 bp, Homo sapiens
acaccttccttttttctctgg

SEQ ID NO: 2837 - DNA, 21 bp, Homo sapiens
ggttcctgggacctggccact

SEQ ID NO: 2838 - DNA, 21 bp, Homo sapiens
cactctcttccgtggggccat

SEQ ID NO: 2839 - DNA, 21 bp, Homo sapiens
cgcagcttacacatgttcttg

SEQ ID NO: 2840 - DNA, 21 bp, Homo sapiens
ccctggtagcggacccagtag

SEQ ID NO: 2841 - DNA, 21 bp, Homo sapiens
cttggccggccctgtctttta

SEQ ID NO: 2842 - DNA, 21 bp, Homo sapiens
gacatacactggctgcagctc

SEQ ID NO: 2843 - DNA, 21 bp, Homo sapiens
gttagcacctggccactcaat

SEQ ID NO: 2844 - DNA, 21 bp, Homo sapiens
gactctctccgccaccacaaa

SEQ ID NO: 2845 - DNA, 21 bp, Homo sapiens
gctcagagaagcgagcccgca

SEQ ID NO: 2846 - DNA, 21 bp, Homo sapiens
ccacgatggtggacatccata

SEQ ID NO: 2847 - DNA, 21 bp, Homo sapiens
ggagtgcagcgggaacagaat

SEQ ID NO: 2848 - DNA, 21 bp, Homo sapiens
cagagagggcgccttccccat

SEQ ID NO: 2849 - DNA, 21 bp, Homo sapiens
ctgaccccaggtccaccaagc

SEQ ID NO: 2850 - DNA, 21 bp, Homo sapiens
cagcagaagcggccagaatcc

SEQ ID NO: 2851 - DNA, 21 bp, Homo sapiens
tcttaccagaggaggcagtgg

SEQ ID NO: 2852 - DNA, 21 bp, Homo sapiens
tttgtggggcgttgctgatga

SEQ ID NO: 2853 - DNA, 21 bp, Homo sapiens
tacacacatacaataataact

SEQ ID NO: 2854 - DNA, 21 bp, Homo sapiens
ctgattgttcgtcattacgag

SEQ ID NO: 2855 - DNA, 20 bp, Homo sapiens
gtgagtggcaggtctttcct

SEQ ID NO: 2856 - DNA, 21 bp, Homo sapiens
tattttgctcgagtccatggt

SEQ ID NO: 2857 - DNA, 21 bp, Homo sapiens
gaactcaggcgtatgccagct

SEQ ID NO: 2858 - DNA, 21 bp, Homo sapiens
gctactcctccgctacagccc

SEQ ID NO: 2859 - DNA, 21 bp, Homo sapiens
ttggattgaaggtaaggaaca

SEQ ID NO: 2860 - DNA, 21 bp, Homo sapiens
gctccacacccccgtgtactt

SEQ ID NO: 2861 - DNA, 21 bp, Homo sapiens
ttgtctctaggtgtaaaacaa

SEQ ID NO: 2862 - DNA, 21 bp, Homo sapiens
gtctccaagagacgtttcatt

SEQ ID NO: 2863 - DNA, 21 bp, Homo sapiens
atgggacagtttgaccacccc

SEQ ID NO: 2864 - DNA, 21 bp, Homo sapiens
aaatttacttgatttgtcaaa

SEQ ID NO: 2865 - DNA, 21 bp, Homo sapiens
aaattctgctcagcaagtgtt

SEQ ID NO: 2866 - DNA, 21 bp, Homo sapiens
atggcatcacgccaggaagaa

SEQ ID NO: 2867 - DNA, 21 bp, Homo sapiens
gacaggtgagacaacgccttg

SEQ ID NO: 2868 - DNA, 21 bp, Homo sapiens
ttcccgatgactctgcaacca

SEQ ID NO: 2869 - DNA, 21 bp, Homo sapiens
atgaccttaacggtatttttt

SEQ ID NO: 2870 - DNA, 21 bp, Homo sapiens
aggtcataccgtctggcaagt

SEQ ID NO: 2871 - DNA, 21 bp, Homo sapiens
tttgtgccaacggacccattc

SEQ ID NO: 2872 - DNA, 21 bp, Homo sapiens
catgccccgcgtggtggcctg

SEQ ID NO: 2873 - DNA, 21 bp, Homo sapiens
catctaagtgcaaaggacatg

SEQ ID NO: 2874 - DNA, 21 bp, Homo sapiens
catcgttggacgcctcccctg

SEQ ID NO: 2875 - DNA, 21 bp, Homo sapiens
gcaacctctcggcacctgctc

SEQ ID NO: 2876 - DNA, 21 bp, Homo sapiens
ggtaaaaagactcaggtttga

SEQ ID NO: 2877 - DNA, 21 bp, Homo sapiens
actgtgggggcgtcgacttcc

SEQ ID NO: 2878 - DNA, 21 bp, Homo sapiens
gaatcgaagagcagcatagga

SEQ ID NO: 2879 - DNA, 21 bp, Homo sapiens
cttgggccagcgccagaactc

SEQ ID NO: 2880 - DNA, 21 bp, Homo sapiens
cctgctgcaggccatctcgag

SEQ ID NO: 2881 - DNA, 21 bp, Homo sapiens
ggcactctcaccatttctagg

SEQ ID NO: 2882 - DNA, 21 bp, Homo sapiens
ctgagttggatctggtgactt

SEQ ID NO: 2883 - DNA, 21 bp, Homo sapiens
cgccgccaccgccgccgagga

SEQ ID NO: 2884 - DNA, 21 bp, Homo sapiens
ggaaagaagatttaggtgact

SEQ ID NO: 2885 - DNA, 21 bp, Homo sapiens
atggtgacccgtttggcatgg

SEQ ID NO: 2886 - DNA, 21 bp, Homo sapiens
cctgctgtgtgtactttgaag

SEQ ID NO: 2887 - DNA, 21 bp, Homo sapiens
gttgtccagacgcagttctct

SEQ ID NO: 2888 - DNA, 21 bp, Homo sapiens
cacgaacggcgctgggccgtg

SEQ ID NO: 2889 - DNA, 21 bp, Homo sapiens
accaagcaaaatagtgtgcct

SEQ ID NO: 2890 - DNA, 21 bp, Homo sapiens
acacctgtaccaaagctaaaa

SEQ ID NO: 2891 - DNA, 21 bp, Homo sapiens
ctgtgccacagtaagagttca

SEQ ID NO: 2892 - DNA, 21 bp, Homo sapiens
cccattactacgagcagaccc

SEQ ID NO: 2893 - DNA, 21 bp, Homo sapiens
gcgggaactgcccctgtatcg

SEQ ID NO: 2894 - DNA, 21 bp, Homo sapiens
gtgccctgggcgatgtcagcg

SEQ ID NO: 2895 - DNA, 21 bp, Homo sapiens
taagtctcagcagggctcgcc

SEQ ID NO: 2896 - DNA, 21 bp, Homo sapiens
aaaacaacagtgtccccaggt

SEQ ID NO: 2897 - DNA, 21 bp, Homo sapiens
tggtacgtgacgggcccggga

SEQ ID NO: 2898 - DNA, 21 bp, Homo sapiens
agataaagaacagtgttctac

SEQ ID NO: 2899 - DNA, 22 bp, Homo sapiens
tccttcagttcgcctgccacag

SEQ ID NO: 2900 - DNA, 21 bp, Homo sapiens
ttggcgtctggtacctgctga

SEQ ID NO: 2901 - DNA, 21 bp, Homo sapiens
aaaaattcaattcatttcacc

SEQ ID NO: 2902 - DNA, 21 bp, Homo sapiens
aaagcagccacctttgccttt

SEQ ID NO: 2903 - DNA, 21 bp, Homo sapiens
catggtggaaactatctaaac

SEQ ID NO: 2904 - DNA, 21 bp, Homo sapiens
atgcctccgtgaggctacatt

SEQ ID NO: 2905 - DNA, 21 bp, Homo sapiens
gtgatgcccaacttatttatt

SEQ ID NO: 2906 - DNA, 21 bp, Homo sapiens
cctgttcaagccccacctgat

SEQ ID NO: 2907 - DNA, 21 bp, Homo sapiens
ggtgaactcccgcccacaaat

SEQ ID NO: 2908 - DNA, 21 bp, Homo sapiens
aacagatgtcgtagagtgcct

SEQ ID NO: 2909 - DNA, 21 bp, Homo sapiens
ctggatttgcgcccaaagagc

SEQ ID NO: 2910 - DNA, 21 bp, Homo sapiens
ccagaaagatcaaaagtgatt

SEQ ID NO: 2911 - DNA, 21 bp, Homo sapiens
agaggctctcgcggcgcgtgt

SEQ ID NO: 2912 - DNA, 21 bp, Homo sapiens
atgaggaagaggatgatgagg

SEQ ID NO: 2913 - DNA, 21 bp, Homo sapiens
atcaggatttcgagcaagctg

SEQ ID NO: 2914 - DNA, 21 bp, Homo sapiens
cctggaataacgccagtcttt

SEQ ID NO: 2915 - DNA, 21 bp, Homo sapiens
aggggccagacggggcctccc

SEQ ID NO: 2916 - DNA, 21 bp, Homo sapiens
tcggtgtagacggctagtatt

SEQ ID NO: 2917 - DNA, 21 bp, Homo sapiens
ctcgtttcaccaagtctgaaa

SEQ ID NO: 2918 - DNA, 21 bp, Homo sapiens
tcacctgttgtcacatttatg

SEQ ID NO: 2919 - DNA, 21 bp, Homo sapiens
ccgaggttatcacctccgaca

SEQ ID NO: 2920 - DNA, 21 bp, Homo sapiens
tggtcttcatgttgttaatct

SEQ ID NO: 2921 - DNA, 21 bp, Homo sapiens
tgaggcagggggagaagcttt

SEQ ID NO: 2922 - DNA, 21 bp, Homo sapiens
agtcagtcgcgcacgctcaat

SEQ ID NO: 2923 - DNA, 21 bp, Homo sapiens
cacagggtgcggggccagcac

SEQ ID NO: 2924 - DNA, 21 bp, Homo sapiens
ctctgaataacaaagtccaaa

SEQ ID NO: 2925 - DNA, 21 bp, Homo sapiens
gagatggcgtcccagcctcag

SEQ ID NO: 2926 - DNA, 21 bp, Homo sapiens
agaacatatcgaaaagagccc

SEQ ID NO: 2927 - DNA, 21 bp, Homo sapiens
ctcgaatacgtttccgtagag

SEQ ID NO: 2928 - DNA, 21 bp, Homo sapiens
aaattcagaggagttacatcg

SEQ ID NO: 2929 - DNA, 21 bp, Homo sapiens
agacagccccgccccccttgt

SEQ ID NO: 2930 - DNA, 21 bp, Homo sapiens
gatcatgagattagtcaagtt

SEQ ID NO: 2931 - DNA, 21 bp, Homo sapiens
agtcttcagagacgcttgttt

SEQ ID NO: 2932 - DNA, 21 bp, Homo sapiens
tggccctgcgcccccctgtat

SEQ ID NO: 2933 - DNA, 21 bp, Homo sapiens
ttaccgttacgcggtaggttc

SEQ ID NO: 2934 - DNA, 21 bp, Homo sapiens
cctggcctacgcaggcttccg

SEQ ID NO: 2935 - DNA, 21 bp, Homo sapiens
gaaaaatgactgaagaattcg

SEQ ID NO: 2936 - DNA, 21 bp, Homo sapiens
aaggtaactcgtgctgatggc

SEQ ID NO: 2937 - DNA, 21 bp, Homo sapiens
tatcagtgatggcatgaattc

SEQ ID NO: 2938 - DNA, 21 bp, Homo sapiens
aactggcttccggccagtacg

SEQ ID NO: 2939 - DNA, 21 bp, Homo sapiens
tctcatagatggtcaatgcgg

SEQ ID NO: 2940 - DNA, 21 bp, Homo sapiens
tagctgggaagcacacagcca

SEQ ID NO: 2941 - DNA, 21 bp, Homo sapiens
gataatatcccgtggaccgat

SEQ ID NO: 2942 - DNA, 21 bp, Homo sapiens
agtcacagcatgtgtaatctc

SEQ ID NO: 2943 - DNA, 21 bp, Homo sapiens
tggtgggtggctccatccctg

SEQ ID NO: 2944 - DNA, 21 bp, Homo sapiens
tctcccttatggacctgatgt

SEQ ID NO: 2945 - DNA, 21 bp, Homo sapiens
agcagcagacacctcctcctc

SEQ ID NO: 2946 - DNA, 21 bp, Homo sapiens
ctttattggtcacactgtcta

SEQ ID NO: 2947 - DNA, 21 bp, Homo sapiens
accaccaaaagctggtacaaa

SEQ ID NO: 2948 - DNA, 21 bp, Homo sapiens
tatctgtggcgcgattatctg

SEQ ID NO: 2949 - DNA, 21 bp, Homo sapiens
atctaagccacattctccatc

SEQ ID NO: 2950 - DNA, 21 bp, Homo sapiens
tcatgtttaacttcaagggct

SEQ ID NO: 2951 - DNA, 22 bp, Homo sapiens
tagttaccacagcagccacttg

SEQ ID NO: 2952 - DNA, 21 bp, Homo sapiens
ctcttgggaagcatgaggaag

SEQ ID NO: 2953 - DNA, 20 bp, Homo sapiens
ctgactggctgtttcagctc

SEQ ID NO: 2954 - DNA, 21 bp, Homo sapiens
ccaccaaccggatatccttta

SEQ ID NO: 2955 - DNA, 21 bp, Homo sapiens
ctttttgatcgtggtacaata

SEQ ID NO: 2956 - DNA, 21 bp, Homo sapiens
cttactgtctgggcgcttatg

SEQ ID NO: 2957 - DNA, 21 bp, Homo sapiens
gttgagcaaacggccgatttt

SEQ ID NO: 2958 - DNA, 21 bp, Homo sapiens
tttctgaagagcctgaagact

SEQ ID NO: 2959 - DNA, 21 bp, Homo sapiens
aacggctgtgcggaggcaacg

SEQ ID NO: 2960 - DNA, 21 bp, Homo sapiens
atgagaacaacttggtcatga

SEQ ID NO: 2961 - DNA, 21 bp, Homo sapiens
agactcaggacgcaacctacc

SEQ ID NO: 2962 - DNA, 21 bp, Homo sapiens
gcctgcttaccagccattttg

SEQ ID NO: 2963 - DNA, 21 bp, Homo sapiens
tccttggccaccagtgccgcc

SEQ ID NO: 2964 - DNA, 21 bp, Homo sapiens
ccttggccaccagtgccgcct

SEQ ID NO: 2965 - DNA, 21 bp, Homo sapiens
gagttacctacgagaattcac

SEQ ID NO: 2966 - DNA, 21 bp, Homo sapiens
aaaaattcaattcatttcacc

SEQ ID NO: 2967 - DNA, 21 bp, Homo sapiens
agccctgagcgttctgagctc

SEQ ID NO: 2968 - DNA, 21 bp, Homo sapiens
ccagtagatgcgcatgttact

SEQ ID NO: 2969 - DNA, 21 bp, Homo sapiens
actgatatttcccctcactgg

SEQ ID NO: 2970 - DNA, 21 bp, Homo sapiens
agcctctttcgaaagcccctt

SEQ ID NO: 2971 - DNA, 21 bp, Homo sapiens
caagagagtcctaaaatggaa

SEQ ID NO: 2972 - DNA, 21 bp, Homo sapiens
tcagtcaggaggtcatgtttg

SEQ ID NO: 2973 - DNA, 21 bp, Homo sapiens
cagaggaaagagtagtacagc

SEQ ID NO: 2974 - DNA, 21 bp, Homo sapiens
ggtgaggggtccctccctaag

SEQ ID NO: 2975 - DNA, 21 bp, Homo sapiens
gatgaagcctacaaatatatc

SEQ ID NO: 2976 - DNA, 21 bp, Homo sapiens
tttcaccagggcagccatggg

SEQ ID NO: 2977 - DNA, 21 bp, Homo sapiens
ccctcggcaccagaaacctgg

SEQ ID NO: 2978 - DNA, 21 bp, Homo sapiens
aaaaattcaattcatttcacc

SEQ ID NO: 2979 - DNA, 21 bp, Homo sapiens
cccccatgccccgtatggtgc

SEQ ID NO: 2980 - DNA, 21 bp, Homo sapiens
caattgctgacggtactagca

SEQ ID NO: 2981 - DNA, 21 bp, Homo sapiens
ggtggggcccgcctgacgcag

SEQ ID NO: 2982 - DNA, 21 bp, Homo sapiens
ggggatggcagccagggaggc

SEQ ID NO: 2983 - DNA, 21 bp, Homo sapiens
ccagttgacatagcatataag

SEQ ID NO: 2984 - DNA, 21 bp, Homo sapiens
gcagagatcacctcagtgaca

SEQ ID NO: 2985 - DNA, 21 bp, Homo sapiens
tgtgtctcacgcaggagaaat

SEQ ID NO: 2986 - DNA, 21 bp, Homo sapiens
tagttatagcatcaaaggtta

SEQ ID NO: 2987 - DNA, 21 bp, Homo sapiens
gatgtttgccgttccaacagc

SEQ ID NO: 2988 - DNA, 21 bp, Homo sapiens
gtgagacctggtgcttcgcag

SEQ ID NO: 2989 - DNA, 21 bp, Homo sapiens
aatgcctccacgaccatcatc

SEQ ID NO: 2990 - DNA, 21 bp, Homo sapiens
attttcctcacggttggaggg

SEQ ID NO: 2991 - DNA, 21 bp, Homo sapiens
aatgtgtgccgcttctgggaa

SEQ ID NO: 2992 - DNA, 21 bp, Homo sapiens
tccatcatggcgacggttctc

SEQ ID NO: 2993 - DNA, 21 bp, Homo sapiens
ccagcccagcgcgttggccca

SEQ ID NO: 2994 - DNA, 21 bp, Homo sapiens
accaagttacccatcaggtca

SEQ ID NO: 2995 - DNA, 21 bp, Homo sapiens
tggagctcgtggagaccaggc

SEQ ID NO: 2996 - DNA, 21 bp, Homo sapiens
ctggcagggcgggtggcttgt

SEQ ID NO: 2997 - DNA, 21 bp, Homo sapiens
cacacttgaagttagcacgcg

SEQ ID NO: 2998 - DNA, 21 bp, Homo sapiens
gcccccgtggcgatccgagat

SEQ ID NO: 2999 - DNA, 21 bp, Homo sapiens
tggagcacccgcatgattgac

SEQ ID NO: 3000 - DNA, 21 bp, Homo sapiens
gggggctgtccggccctttta

SEQ ID NO: 3001 - DNA, 21 bp, Homo sapiens
tggatatgttatcatgtggaa

SEQ ID NO: 3002 - DNA, 21 bp, Homo sapiens
tcacctggtcgtgtgaggagc

SEQ ID NO: 3003 - DNA, 21 bp, Homo sapiens
gaagaagaaacgagagggaat

SEQ ID NO: 3004 - DNA, 21 bp, Homo sapiens
gctgggatggcgaaagccagc

SEQ ID NO: 3005 - DNA, 21 bp, Homo sapiens
aagaagaatcgttgccatggt

SEQ ID NO: 3006 - DNA, 21 bp, Homo sapiens
ggcgggccgtgacttgctgca

SEQ ID NO: 3007 - DNA, 21 bp, Homo sapiens
tcacagcggcggatacagtgg

SEQ ID NO: 3008 - DNA, 21 bp, Homo sapiens
ataattcatccgtggtttcaa

SEQ ID NO: 3009 - DNA, 21 bp, Homo sapiens
ttgaaccacctaaaaagaaaa

SEQ ID NO: 3010 - DNA, 21 bp, Homo sapiens
actacccctgcgctcggggta

SEQ ID NO: 3011 - DNA, 21 bp, Homo sapiens
gcaattcttcgaagttcaaat

SEQ ID NO: 3012 - DNA, 21 bp, Homo sapiens
aagctctatacgaaattcttg

SEQ ID NO: 3013 - DNA, 21 bp, Homo sapiens
tcagcctcaacgccctggcgc

SEQ ID NO: 3014 - DNA, 21 bp, Homo sapiens
cctacgtgaatgtaaatattc

SEQ ID NO: 3015 - DNA, 21 bp, Homo sapiens
tctcaaagtcttttccatcat

SEQ ID NO: 3016 - DNA, 20 bp, Homo sapiens
ttctgtggctggttcctctg

SEQ ID NO: 3017 - DNA, 21 bp, Homo sapiens
aacttcctccgttgccaaaat

SEQ ID NO: 3018 - DNA, 21 bp, Homo sapiens
cagggacagcgtctccgtggt

SEQ ID NO: 3019 - DNA, 21 bp, Homo sapiens
gctgtccgtcgggggtgccag

SEQ ID NO: 3020 - DNA, 21 bp, Homo sapiens
agaaaattccgaagatcaata

SEQ ID NO: 3021 - DNA, 21 bp, Homo sapiens
ttcaaaatgtgccagttccac

SEQ ID NO: 3022 - DNA, 21 bp, Homo sapiens
cagaaccaacgtgagtattgt

SEQ ID NO: 3023 - DNA, 21 bp, Homo sapiens
gtagtccatacgtttgggttg

SEQ ID NO: 3024 - DNA, 21 bp, Homo sapiens
tcacccttaaggtggcgtctc

SEQ ID NO: 3025 - DNA, 21 bp, Homo sapiens
tgtggatgtggaccatgggct

SEQ ID NO: 3026 - DNA, 21 bp, Homo sapiens
taagattaccggagaaatggt

SEQ ID NO: 3027 - DNA, 21 bp, Homo sapiens
agatacatttgacagacgtct

SEQ ID NO: 3028 - DNA, 21 bp, Homo sapiens
agtggagcccgcctcttcttg

SEQ ID NO: 3029 - DNA, 21 bp, Homo sapiens
gcagctgactcaggtcattga

SEQ ID NO: 3030 - DNA, 21 bp, Homo sapiens
gtggccagcacgtagataatg

SEQ ID NO: 3031 - DNA, 21 bp, Homo sapiens
tctttggcaccggccctctga

SEQ ID NO: 3032 - DNA, 21 bp, Homo sapiens
tgattcaccgggatttgaagc

SEQ ID NO: 3033 - DNA, 21 bp, Homo sapiens
tagccaccaacaataacaaat

SEQ ID NO: 3034 - DNA, 21 bp, Homo sapiens
aagcttccagatgacactacc

SEQ ID NO: 3035 - DNA, 21 bp, Homo sapiens
taggatggccccccgcaagcg

SEQ ID NO: 3036 - DNA, 21 bp, Homo sapiens
tgtatacctccttagccagca

SEQ ID NO: 3037 - DNA, 21 bp, Homo sapiens
tctccttcaacgctctggagt

SEQ ID NO: 3038 - DNA, 21 bp, Homo sapiens
tggctgatagcctgaagagga

SEQ ID NO: 3039 - DNA, 22 bp, Homo sapiens
ttactggcggtagttgtaggca

SEQ ID NO: 3040 - DNA, 21 bp, Homo sapiens
cattttgcgcaaaaagaactc

SEQ ID NO: 3041 - DNA, 21 bp, Homo sapiens
actgccatcaccatcttccat

SEQ ID NO: 3042 - DNA, 21 bp, Homo sapiens
ccaggttgaagggtccttaga

SEQ ID NO: 3043 - DNA, 21 bp, Homo sapiens
ggtgcgtccacgggaaccaat

SEQ ID NO: 3044 - DNA, 21 bp, Homo sapiens
aggacttattcagcataagag

SEQ ID NO: 3045 - DNA, 21 bp, Homo sapiens
agaaaacctcgaagccttgtg

SEQ ID NO: 3046 - DNA, 21 bp, Homo sapiens
tgttctcctacgtaaagatca

SEQ ID NO: 3047 - DNA, 21 bp, Homo sapiens
tgtgtcataaaccagatgtgg

SEQ ID NO: 3048 - DNA, 21 bp, Homo sapiens
agaggtttgtctggctgaggt

SEQ ID NO: 3049 - DNA, 21 bp, Homo sapiens
ttggagttgaacagttttcta

SEQ ID NO: 3050 - DNA, 21 bp, Homo sapiens
aaaattagaacggaatagaga

SEQ ID NO: 3051 - DNA, 21 bp, Homo sapiens
tgtacacagaagaacattcgt

SEQ ID NO: 3052 - DNA, 20 bp, Homo sapiens
tttagtggcagctgaaatat

SEQ ID NO: 3053 - DNA, 21 bp, Homo sapiens
atgccatcgagaattacatca

SEQ ID NO: 3054 - DNA, 21 bp, Homo sapiens
aaatggcatacggagtgatgt

SEQ ID NO: 3055 - DNA, 21 bp, Homo sapiens
tgccaagatccgtagctgggc

SEQ ID NO: 3056 - DNA, 21 bp, Homo sapiens
actatttccccattacggtaa

SEQ ID NO: 3057 - DNA, 21 bp, Homo sapiens
gaaaaggggacggcctgcagg

SEQ ID NO: 3058 - DNA, 21 bp, Homo sapiens
aaattggtaataaaaatgcct

SEQ ID NO: 3059 - DNA, 21 bp, Homo sapiens
acttacggatcgacagattga

SEQ ID NO: 3060 - DNA, 21 bp, Homo sapiens
agaactggaacgtctccagaa

SEQ ID NO: 3061 - DNA, 21 bp, Homo sapiens
tgatgcatttgcaaagggccc

SEQ ID NO: 3062 - DNA, 21 bp, Homo sapiens
agaatgttcacgccggcgctt

SEQ ID NO: 3063 - DNA, 21 bp, Homo sapiens
cattggagatggcatggaaag

SEQ ID NO: 3064 - DNA, 21 bp, Homo sapiens
gactgaacctcagtagcagtc

SEQ ID NO: 3065 - DNA, 21 bp, Homo sapiens
gttgggcagtgctaggaaaga

SEQ ID NO: 3066 - DNA, 21 bp, Homo sapiens
cagcacctcccctgtgcggcg

SEQ ID NO: 3067 - DNA, 21 bp, Homo sapiens
ggccgctcacgtaccgagcca

SEQ ID NO: 3068 - DNA, 21 bp, Homo sapiens
tcgacgttgcgtcctcgcacg

SEQ ID NO: 3069 - DNA, 21 bp, Homo sapiens
catgaggacagagatgccact

SEQ ID NO: 3070 - DNA, 21 bp, Homo sapiens
tgaccgactttgccacatgga

SEQ ID NO: 3071 - DNA, 21 bp, Homo sapiens
gatcgagcctcgagagagagc

SEQ ID NO: 3072 - DNA, 21 bp, Homo sapiens
tgctgtagaacgatgagttgg

SEQ ID NO: 3073 - DNA, 21 bp, Homo sapiens
tttttccagggattttttcag

SEQ ID NO: 3074 - DNA, 21 bp, Homo sapiens
gagggaagaattgttccttcg

SEQ ID NO: 3075 - DNA, 21 bp, Homo sapiens
acagcgaggccaggatggagc

SEQ ID NO: 3076 - DNA, 21 bp, Homo sapiens
accccagcctcagccagtccc

SEQ ID NO: 3077 - DNA, 21 bp, Homo sapiens
atacagtcccataccacttcg

SEQ ID NO: 3078 - DNA, 21 bp, Homo sapiens
gtccaccatcgtctgtatgga

SEQ ID NO: 3079 - DNA, 21 bp, Homo sapiens
actcgtgcggcttctcctgct

SEQ ID NO: 3080 - DNA, 21 bp, Homo sapiens
ctgttgtccaaggggtgaagt

SEQ ID NO: 3081 - DNA, 21 bp, Homo sapiens
ggccctactggaagtgaagag

SEQ ID NO: 3082 - DNA, 21 bp, Homo sapiens
gtgcagggaggggaccaggac

SEQ ID NO: 3083 - DNA, 21 bp, Homo sapiens
tcctatgtccgcattttctgg

SEQ ID NO: 3084 - DNA, 21 bp, Homo sapiens
aagaggacgtcggcatcgggg

SEQ ID NO: 3085 - DNA, 20 bp, Homo sapiens
tggagtggctggggaacatg

SEQ ID NO: 3086 - DNA, 21 bp, Homo sapiens
atggcgcccacggcttcgttt

SEQ ID NO: 3087 - DNA, 21 bp, Homo sapiens
aaaaaccgtccggaggagcgg

SEQ ID NO: 3088 - DNA, 21 bp, Homo sapiens
acggcgccggcgcccaggtat

SEQ ID NO: 3089 - DNA, 21 bp, Homo sapiens
agggacagctggaacaagggg

SEQ ID NO: 3090 - DNA, 21 bp, Homo sapiens
tgctcacataggagtaaagga

SEQ ID NO: 3091 - DNA, 21 bp, Homo sapiens
gatatatactgaccactgcaa

SEQ ID NO: 3092 - DNA, 21 bp, Homo sapiens
tgtcttagtggccaaaattgt

SEQ ID NO: 3093 - DNA, 21 bp, Homo sapiens
gctatgaagacgccaaggcct

SEQ ID NO: 3094 - DNA, 21 bp, Homo sapiens
ggggatttaggtagcggcacc

SEQ ID NO: 3095 - DNA, 22 bp, Homo sapiens
ccaatagcacagctgccagtag

SEQ ID NO: 3096 - DNA, 21 bp, Homo sapiens
tcctcgaggtctttgaggatc

SEQ ID NO: 3097 - DNA, 22 bp, Homo sapiens
tttatggcggttggctgctcct

SEQ ID NO: 3098 - DNA, 23 bp, Homo sapiens
caatgtgcttgaagaagttgttc

SEQ ID NO: 3099 - DNA, 21 bp, Homo sapiens
cctacggacagatcggtgcgc

SEQ ID NO: 3100 - DNA, 21 bp, Homo sapiens
attgagagggcgggccagctc

SEQ ID NO: 3101 - DNA, 21 bp, Homo sapiens
gtcatgctccgaagccactca

SEQ ID NO: 3102 - DNA, 21 bp, Homo sapiens
ctcactggggcgtttctcttt

SEQ ID NO: 3103 - DNA, 21 bp, Homo sapiens
tttccaattcggaatgtgaga

SEQ ID NO: 3104 - DNA, 21 bp, Homo sapiens
taaccctctcgtatacaccct

SEQ ID NO: 3105 - DNA, 21 bp, Homo sapiens
aagacctgcccggcaggagtc

SEQ ID NO: 3106 - DNA, 21 bp, Homo sapiens
ggtttagtgcgttccaggggt

SEQ ID NO: 3107 - DNA, 21 bp, Homo sapiens
ggttggttgccttggttgtca

SEQ ID NO: 3108 - DNA, 20 bp, Homo sapiens
aggtagcaaaccagccactt

SEQ ID NO: 3109 - DNA, 21 bp, Homo sapiens
gttgggtgcgagttcaaccag

SEQ ID NO: 3110 - DNA, 21 bp, Homo sapiens
tcctgggcccgcacgctaatg

SEQ ID NO: 3111 - DNA, 21 bp, Homo sapiens
cactgttgtcgtattgtagag

SEQ ID NO: 3112 - DNA, 21 bp, Homo sapiens
agctcttccaggacacggagg

SEQ ID NO: 3113 - DNA, 21 bp, Homo sapiens
ggaatgcaagcagttgtgaat

SEQ ID NO: 3114 - DNA, 21 bp, Homo sapiens
cccccggttcggccacctacg

SEQ ID NO: 3115 - DNA, 21 bp, Homo sapiens
gccctgcgccgagtctgggtc

SEQ ID NO: 3116 - DNA, 21 bp, Homo sapiens
ctgagccactcaccagtcagc

SEQ ID NO: 3117 - DNA, 21 bp, Homo sapiens
tcccgtcaatttcaaccatgg

SEQ ID NO: 3118 - DNA, 21 bp, Homo sapiens
agctcctcaacaatcagctct

SEQ ID NO: 3119 - DNA, 23 bp, Homo sapiens
ggagtggctagctaatgagacaa

SEQ ID NO: 3120 - DNA, 21 bp, Homo sapiens
aaacattcttgtcatacgaag

SEQ ID NO: 3121 - DNA, 21 bp, Homo sapiens
ctggtcgcagcagaactggag

SEQ ID NO: 3122 - DNA, 21 bp, Homo sapiens
ctggggcaggcgcacagtcac

SEQ ID NO: 3123 - DNA, 21 bp, Homo sapiens
caccagtggacggggatcccc

SEQ ID NO: 3124 - DNA, 21 bp, Homo sapiens
taacttacttatctcctttgc

SEQ ID NO: 3125 - DNA, 21 bp, Homo sapiens
tctggtggatgtgctggtact

SEQ ID NO: 3126 - DNA, 21 bp, Homo sapiens
agatcagttttttctgtaata

SEQ ID NO: 3127 - DNA, 21 bp, Homo sapiens
ccagcagccatgttttctgca

SEQ ID NO: 3128 - DNA, 21 bp, Homo sapiens
gtgcctcctcgcctgtcagag

SEQ ID NO: 3129 - DNA, 21 bp, Homo sapiens
ggggctcaggcgactttcccc

SEQ ID NO: 3130 - DNA, 21 bp, Homo sapiens
accagctcagcggccagttag

SEQ ID NO: 3131 - DNA, 21 bp, Homo sapiens
agtggagcagctgttgttcat

SEQ ID NO: 3132 - DNA, 21 bp, Homo sapiens
cgatgtattcgtagtacccac

SEQ ID NO: 3133 - DNA, 21 bp, Homo sapiens
cagccacttgatagatgcctg

SEQ ID NO: 3134 - DNA, 21 bp, Homo sapiens
ccttctacaacgaagcccggg

SEQ ID NO: 3135 - DNA, 21 bp, Homo sapiens
ggagggtaacgaagaggaaga

SEQ ID NO: 3136 - DNA, 23 bp, Homo sapiens
tgtctaaaaggaagaagaagaat

SEQ ID NO: 3137 - DNA, 21 bp, Homo sapiens
gttgcttaggtcaagcctttc

SEQ ID NO: 3138 - DNA, 21 bp, Homo sapiens
tggtatttcatgcagaagtac

SEQ ID NO: 3139 - DNA, 21 bp, Homo sapiens
gggttgggcaccgtctcctct

SEQ ID NO: 3140 - DNA, 21 bp, Homo sapiens
tctctatgggcgcttgtatga

SEQ ID NO: 3141 - DNA, 21 bp, Homo sapiens
tctgtccagcccacagcaatg

SEQ ID NO: 3142 - DNA, 21 bp, Homo sapiens
gccacatagacggctgcagtc

SEQ ID NO: 3143 - DNA, 21 bp, Homo sapiens
caggaactacatcagtcactg

SEQ ID NO: 3144 - DNA, 21 bp, Homo sapiens
catttcaccaataataccacg

SEQ ID NO: 3145 - DNA, 21 bp, Homo sapiens
caccaccagccctaagatcat

SEQ ID NO: 3146 - DNA, 21 bp, Homo sapiens
gtgagaattcggctggctgac

SEQ ID NO: 3147 - DNA, 21 bp, Homo sapiens
gcctgggggaagcccctgctg

SEQ ID NO: 3148 - DNA, 21 bp, Homo sapiens
aagaaggagccctttcccaga

SEQ ID NO: 3149 - DNA, 21 bp, Homo sapiens
gggagactacgacccagaact

SEQ ID NO: 3150 - DNA, 22 bp, Homo sapiens
ctctgccagcagccctgccgat

SEQ ID NO: 3151 - DNA, 21 bp, Homo sapiens
tgaaactcttaagtatatctg

SEQ ID NO: 3152 - DNA, 21 bp, Homo sapiens
gggagatgccgtccagctcgc

SEQ ID NO: 3153 - DNA, 21 bp, Homo sapiens
ctggctttccgccacatcagg

SEQ ID NO: 3154 - DNA, 21 bp, Homo sapiens
atgtagagggcgttgaaaatt

SEQ ID NO: 3155 - DNA, 21 bp, Homo sapiens
agaggagggtggaaatgaagg

SEQ ID NO: 3156 - DNA, 21 bp, Homo sapiens
gaagatgatagtgaaggccac

SEQ ID NO: 3157 - DNA, 21 bp, Homo sapiens
tacactgttacgacataaagt

SEQ ID NO: 3158 - DNA, 21 bp, Homo sapiens
ccttccactcggataagatgc

SEQ ID NO: 3159 - DNA, 21 bp, Homo sapiens
agatgctggaggtgaggatgg

SEQ ID NO: 3160 - DNA, 21 bp, Homo sapiens
gctcctggagcgtgtctgtgg

SEQ ID NO: 3161 - DNA, 21 bp, Homo sapiens
cggctccttggtgaagctgta

SEQ ID NO: 3162 - DNA, 21 bp, Homo sapiens
tcagttgaccggtcagaccct

SEQ ID NO: 3163 - DNA, 21 bp, Homo sapiens
caccttcatacgcccatgtac

SEQ ID NO: 3164 - DNA, 21 bp, Homo sapiens
aaggtccaggcggagttcccc

SEQ ID NO: 3165 - DNA, 21 bp, Homo sapiens
gacaccatgatggagaggcct

SEQ ID NO: 3166 - DNA, 21 bp, Homo sapiens
aggctctgaccgagatggcgg

SEQ ID NO: 3167 - DNA, 21 bp, Homo sapiens
gttggtaggcgtgcgcatggc

SEQ ID NO: 3168 - DNA, 21 bp, Homo sapiens
ccactgtagcgaggtctcact

SEQ ID NO: 3169 - DNA, 21 bp, Homo sapiens
tgataggcttcgaccaaaggt

SEQ ID NO: 3170 - DNA, 21 bp, Homo sapiens
atctgtttgggatagtcagta

SEQ ID NO: 3171 - DNA, 21 bp, Homo sapiens
atcacatgcccccgaagatgc

SEQ ID NO: 3172 - DNA, 21 bp, Homo sapiens
cagcttgaaagttctggaaat

SEQ ID NO: 3173 - DNA, 21 bp, Homo sapiens
gggggcaaacctacatctgcc

SEQ ID NO: 3174 - DNA, 21 bp, Homo sapiens
ccatagctttcgtccaggaac

SEQ ID NO: 3175 - DNA, 21 bp, Homo sapiens
aggccggcgggcagctgcggg

SEQ ID NO: 3176 - DNA, 21 bp, Homo sapiens
tgacatgacaatattctgagt

SEQ ID NO: 3177 - DNA, 21 bp, Homo sapiens
gtcgggtgagcccagccagcc

SEQ ID NO: 3178 - DNA, 21 bp, Homo sapiens
tgttgctgccgttgtggtggt

SEQ ID NO: 3179 - DNA, 21 bp, Homo sapiens
cattctcagcgcgggcatctt

SEQ ID NO: 3180 - DNA, 21 bp, Homo sapiens
aagtctccacgtcaggtgtaa

SEQ ID NO: 3181 - DNA, 21 bp, Homo sapiens
gcttcaccatattcttatatt

SEQ ID NO: 3182 - DNA, 21 bp, Homo sapiens
atgagttttcgtttttggtca

SEQ ID NO: 3183 - DNA, 21 bp, Homo sapiens
gttctgctggcttcttcaaga

SEQ ID NO: 3184 - DNA, 21 bp, Homo sapiens
gccagaactagccaatacttt

SEQ ID NO: 3185 - DNA, 21 bp, Homo sapiens
ggccagaactagccaatactt

SEQ ID NO: 3186 - DNA, 22 bp, Homo sapiens
gaggcagcacagctgccatgat

SEQ ID NO: 3187 - DNA, 21 bp, Homo sapiens
ttacctgccattacagagtag

SEQ ID NO: 3188 - DNA, 21 bp, Homo sapiens
gggaatatctgggtaagtcat

SEQ ID NO: 3189 - DNA, 21 bp, Homo sapiens
atgcccctgttccctcacgtt

SEQ ID NO: 3190 - DNA, 21 bp, Homo sapiens
aggcgatgcactgtcgaggcc

SEQ ID NO: 3191 - DNA, 21 bp, Homo sapiens
cccgccacccgacgatgagcc

SEQ ID NO: 3192 - DNA, 21 bp, Homo sapiens
cccagaaaaggggacggcctg

SEQ ID NO: 3193 - DNA, 21 bp, Homo sapiens
cccccaaaaacgcaggacttc

SEQ ID NO: 3194 - DNA, 21 bp, Homo sapiens
ctgagaataactctcctggca

SEQ ID NO: 3195 - DNA, 21 bp, Homo sapiens
cgaaaaatgactgaagaattc

SEQ ID NO: 3196 - DNA, 21 bp, Homo sapiens
agaagacgtcggccgtcgccc

SEQ ID NO: 3197 - DNA, 21 bp, Homo sapiens
atgggaagtgacctcgtttgc

SEQ ID NO: 3198 - DNA, 21 bp, Homo sapiens
acctcatgtttgccttctttg

SEQ ID NO: 3199 - DNA, 21 bp, Homo sapiens
aggggcagcaacaccaccagc

SEQ ID NO: 3200 - DNA, 21 bp, Homo sapiens
ggtgggtggctccatccctgt

SEQ ID NO: 3201 - DNA, 21 bp, Homo sapiens
ttctcccagccctacctgccg

SEQ ID NO: 3202 - DNA, 21 bp, Homo sapiens
gactgcctaaaggctttgcca

SEQ ID NO: 3203 - DNA, 21 bp, Homo sapiens
tgtgcactcacggaggaaata

SEQ ID NO: 3204 - DNA, 21 bp, Homo sapiens
taagtggcagacaggtaggcc

SEQ ID NO: 3205 - DNA, 21 bp, Homo sapiens
aaaactaaggcggggcatctt

SEQ ID NO: 3206 - DNA, 21 bp, Homo sapiens
cataccaaagtgacagacttc

SEQ ID NO: 3207 - DNA, 21 bp, Homo sapiens
ttgttgaatcgtagttgtaag

SEQ ID NO: 3208 - DNA, 21 bp, Homo sapiens
ccaggactacgcccagatgaa

SEQ ID NO: 3209 - DNA, 21 bp, Homo sapiens
aataattggcgtcattcacag

SEQ ID NO: 3210 - DNA, 21 bp, Homo sapiens
gagtgggaatcgatcagccgc

SEQ ID NO: 3211 - DNA, 21 bp, Homo sapiens
gggggcatgattgactgcccg

SEQ ID NO: 3212 - DNA, 21 bp, Homo sapiens
aggtctcggacgtcctgctcg

SEQ ID NO: 3213 - DNA, 21 bp, Homo sapiens
ctctctcacagtgatcgcctg

SEQ ID NO: 3214 - DNA, 21 bp, Homo sapiens
tctctcacagtgatcgcctgc

SEQ ID NO: 3215 - DNA, 21 bp, Homo sapiens
ttacgctatatccagaatcgg

SEQ ID NO: 3216 - DNA, 21 bp, Homo sapiens
ggcacctgtgtgggtgtcggc

SEQ ID NO: 3217 - DNA, 21 bp, Homo sapiens
actcaacgctctccatctggc

SEQ ID NO: 3218 - DNA, 21 bp, Homo sapiens
ctcatggccctgcgcaaccac

SEQ ID NO: 3219 - DNA, 21 bp, Homo sapiens
ccaggagcaccaagtgttgct

SEQ ID NO: 3220 - DNA, 21 bp, Homo sapiens
cctgaaaccggatgctgagta

SEQ ID NO: 3221 - DNA, 21 bp, Homo sapiens
tgattgggtttgtaactccgc

SEQ ID NO: 3222 - DNA, 21 bp, Homo sapiens
aatgtcacacggacaaggata

SEQ ID NO: 3223 - DNA, 21 bp, Homo sapiens
atcttggctcggattcaggag

SEQ ID NO: 3224 - DNA, 21 bp, Homo sapiens
aactgcccacgaaattcagat

SEQ ID NO: 3225 - DNA, 21 bp, Homo sapiens
ttgcaatagacgacgtctgcg

SEQ ID NO: 3226 - DNA, 21 bp, Homo sapiens
tcaattttgaatgcaaagaat

SEQ ID NO: 3227 - DNA, 21 bp, Homo sapiens
catcttctgtctcgttctccc

SEQ ID NO: 3228 - DNA, 21 bp, Homo sapiens
ccagcaatggtgttgctctgc

SEQ ID NO: 3229 - DNA, 21 bp, Homo sapiens
acttgttggtgtcttctagct

SEQ ID NO: 3230 - DNA, 21 bp, Homo sapiens
cttgttggtgtcttctagctc

SEQ ID NO: 3231 - DNA, 21 bp, Homo sapiens
gttgccattgaggtaccattc

SEQ ID NO: 3232 - DNA, 21 bp, Homo sapiens
aagtgtacctcgagattcagg

SEQ ID NO: 3233 - DNA, 21 bp, Homo sapiens
gcaggcatggctgttgcaggc

SEQ ID NO: 3234 - DNA, 21 bp, Homo sapiens
cttggccaccagtgccgcctc

SEQ ID NO: 3235 - DNA, 21 bp, Homo sapiens
gcatggcttgggtgtcaacac

SEQ ID NO: 3236 - DNA, 21 bp, Homo sapiens
gcctcaagttcaaggagtttg

SEQ ID NO: 3237 - DNA, 21 bp, Homo sapiens
ttccaaaagctgcaatataag

SEQ ID NO: 3238 - DNA, 21 bp, Homo sapiens
ccaaaggggatatatttcaga

SEQ ID NO: 3239 - DNA, 21 bp, Homo sapiens
gctgcggccctggcaggtacc

SEQ ID NO: 3240 - DNA, 21 bp, Homo sapiens
aacttaaatacgccatcttgg

SEQ ID NO: 3241 - DNA, 21 bp, Homo sapiens
cttgcgggcccctgggccgcg

SEQ ID NO: 3242 - DNA, 21 bp, Homo sapiens
cactgtcttcgtttttttcct

SEQ ID NO: 3243 - DNA, 21 bp, Homo sapiens
cggctcacctcctatgtcttc

SEQ ID NO: 3244 - DNA, 21 bp, Homo sapiens
tgccatctgcgttccaccaat

SEQ ID NO: 3245 - DNA, 21 bp, Homo sapiens
atcttgttatctgcaggatca

SEQ ID NO: 3246 - DNA, 21 bp, Homo sapiens
ttcaattcgcggactaaggcc

SEQ ID NO: 3247 - DNA, 20 bp, Homo sapiens
agtagcggcaggtaactcgg

SEQ ID NO: 3248 - DNA, 21 bp, Homo sapiens
cctgctccccgttccctgcgg

SEQ ID NO: 3249 - DNA, 21 bp, Homo sapiens
tcatccaggacgaagtgctgc

SEQ ID NO: 3250 - DNA, 21 bp, Homo sapiens
tatgaaagacgtttgcatatt

SEQ ID NO: 3251 - DNA, 21 bp, Homo sapiens
tgcagacttcggcctttctcg

SEQ ID NO: 3252 - DNA, 21 bp, Homo sapiens
actgcacccccgcatcgtgca

SEQ ID NO: 3253 - DNA, 21 bp, Homo sapiens
cagctgcgctcggagctgggc

SEQ ID NO: 3254 - DNA, 21 bp, Homo sapiens
tgttctgcaccgttgtcagcc

SEQ ID NO: 3255 - DNA, 21 bp, Homo sapiens
ccgaagtgacgactccacgct

SEQ ID NO: 3256 - DNA, 21 bp, Homo sapiens
gtttgataaacttgttgccct

SEQ ID NO: 3257 - DNA, 21 bp, Homo sapiens
aagacccatcgcgaggaaggg

SEQ ID NO: 3258 - DNA, 21 bp, Homo sapiens
tagcacataccgagggcaact

SEQ ID NO: 3259 - DNA, 21 bp, Homo sapiens
aacacctcaaatctcaacttg

SEQ ID NO: 3260 - DNA, 21 bp, Homo sapiens
gagctgcggcgttgcggggct

SEQ ID NO: 3261 - DNA, 21 bp, Homo sapiens
tttattccacgttgagaaaag

SEQ ID NO: 3262 - DNA, 21 bp, Homo sapiens
attccagttggcatgagcata

SEQ ID NO: 3263 - DNA, 21 bp, Homo sapiens
ttcgaggcaacgagcccacat

SEQ ID NO: 3264 - DNA, 21 bp, Homo sapiens
aaccaccttgcgaatgatcta

SEQ ID NO: 3265 - DNA, 21 bp, Homo sapiens
tgctccatcaagacagggctg

SEQ ID NO: 3266 - DNA, 22 bp, Homo sapiens
tctccttgttcgccagccactg

SEQ ID NO: 3267 - DNA, 21 bp, Homo sapiens
aggacctcaatagctctacag

SEQ ID NO: 3268 - DNA, 21 bp, Homo sapiens
tggttcaggcgcagtttgaca

SEQ ID NO: 3269 - DNA, 21 bp, Homo sapiens
ccatcctgcagggtcccctga

SEQ ID NO: 3270 - DNA, 21 bp, Homo sapiens
atacttttcacaattagcact

SEQ ID NO: 3271 - DNA, 21 bp, Homo sapiens
agggcacacccataataggaa

SEQ ID NO: 3272 - DNA, 21 bp, Homo sapiens
gaagactgccctgaaccagac

SEQ ID NO: 3273 - DNA, 21 bp, Homo sapiens
ttcactgtcacttgggcatgc

SEQ ID NO: 3274 - DNA, 21 bp, Homo sapiens
catatcttccgtctcactgat

SEQ ID NO: 3275 - DNA, 21 bp, Homo sapiens
gctgcaggacgccctatgtca

SEQ ID NO: 3276 - DNA, 21 bp, Homo sapiens
gcgatcattcgtcacagtcgg

SEQ ID NO: 3277 - DNA, 21 bp, Homo sapiens
gtccggaagccctggaggatg

SEQ ID NO: 3278 - DNA, 21 bp, Homo sapiens
tcgtttgatttgaggaatagg

SEQ ID NO: 3279 - DNA, 21 bp, Homo sapiens
cagaattgtgcatcttggggt

SEQ ID NO: 3280 - DNA, 23 bp, Homo sapiens
ctgtttttcaggtggttgactca

SEQ ID NO: 3281 - DNA, 21 bp, Homo sapiens
caactgctgacgatactagca

SEQ ID NO: 3282 - DNA, 21 bp, Homo sapiens
gaaatggcgggtgaaattaca

SEQ ID NO: 3283 - DNA, 21 bp, Homo sapiens
atgtgaaaggatggtgggaag

SEQ ID NO: 3284 - DNA, 21 bp, Homo sapiens
tgcaggtcaccgggcaaggag

SEQ ID NO: 3285 - DNA, 20 bp, Homo sapiens
ccttatggctgggagaaaat

SEQ ID NO: 3286 - DNA, 21 bp, Homo sapiens
agattgtcctccggatttgat

SEQ ID NO: 3287 - DNA, 21 bp, Homo sapiens
atactcctgacgcatgtcatt

SEQ ID NO: 3288 - DNA, 21 bp, Homo sapiens
agaggagggtggaaatgaagg

SEQ ID NO: 3289 - DNA, 21 bp, Homo sapiens
catacctctcgtttatcagag

SEQ ID NO: 3290 - DNA, 21 bp, Homo sapiens
tgggcctcgcctgcttcaagc

SEQ ID NO: 3291 - DNA, 21 bp, Homo sapiens
gaagaggttcctcctccgggt

SEQ ID NO: 3292 - DNA, 22 bp, Homo sapiens
tttatggcggttggctgctcct

SEQ ID NO: 3293 - DNA, 21 bp, Homo sapiens
ctccagtgctggtttcgtacc

SEQ ID NO: 3294 - DNA, 21 bp, Homo sapiens
gtcctgaatcttgcttctaat

SEQ ID NO: 3295 - DNA, 21 bp, Homo sapiens
ggtctgcagcgtctcccggcc

SEQ ID NO: 3296 - DNA, 22 bp, Homo sapiens
aggcggcagcagcagccgcagg

SEQ ID NO: 3297 - DNA, 21 bp, Homo sapiens
agagaagctcggaggaggagg

SEQ ID NO: 3298 - DNA, 20 bp, Homo sapiens
caccagtgccaaagcctcca

SEQ ID NO: 3299 - DNA, 22 bp, Homo sapiens
ggtgatggccatcccagccata

SEQ ID NO: 3300 - DNA, 21 bp, Homo sapiens
aatttcctcagctcacccaaa

SEQ ID NO: 3301 - DNA, 21 bp, Homo sapiens
tccgtacagccggttgaggcg

SEQ ID NO: 3302 - DNA, 21 bp, Homo sapiens
tttcttctggcggcaatggcc

SEQ ID NO: 3303 - DNA, 21 bp, Homo sapiens
gagactccacgttggtgatca

SEQ ID NO: 3304 - DNA, 21 bp, Homo sapiens
aaagatataaagaagtcatcg

SEQ ID NO: 3305 - DNA, 21 bp, Homo sapiens
ctgctggcttcttgggcatga

SEQ ID NO: 3306 - DNA, 21 bp, Homo sapiens
tgatggaaccgtcattgcgga

SEQ ID NO: 3307 - DNA, 21 bp, Homo sapiens
gaccttcttactctcgttcat

SEQ ID NO: 3308 - DNA, 21 bp, Homo sapiens
aagtaaagattcaagaggaat

SEQ ID NO: 3309 - DNA, 20 bp, Homo sapiens
gccagcggctcggacgcttt

SEQ ID NO: 3310 - DNA, 21 bp, Homo sapiens
gaacgtgatccgctacagcct

SEQ ID NO: 3311 - DNA, 21 bp, Homo sapiens
ttagcaacacgtagacattca

SEQ ID NO: 3312 - DNA, 21 bp, Homo sapiens
ctttacaaacagagatgtgat

SEQ ID NO: 3313 - DNA, 21 bp, Homo sapiens
ctcctgggtgaaggcggccat

SEQ ID NO: 3314 - DNA, 21 bp, Homo sapiens
ggtcgtcccgcgccatcttct

SEQ ID NO: 3315 - DNA, 21 bp, Homo sapiens
cataaacaacgtaggaaagcc

SEQ ID NO: 3316 - DNA, 21 bp, Homo sapiens
atattttttcggttgttacgg

SEQ ID NO: 3317 - DNA, 20 bp, Homo sapiens
cttaccggctggccagaccc

SEQ ID NO: 3318 - DNA, 21 bp, Homo sapiens
ataaggcagagcttcatcaca

SEQ ID NO: 3319 - DNA, 21 bp, Homo sapiens
tcatggaccacgagggactga

SEQ ID NO: 3320 - DNA, 21 bp, Homo sapiens
gtattggtccccgtaatagtc

SEQ ID NO: 3321 - DNA, 21 bp, Homo sapiens
aagaagagaactttttcaccc

SEQ ID NO: 3322 - DNA, 21 bp, Homo sapiens
tcttcctcttcgtggagggtg

SEQ ID NO: 3323 - DNA, 21 bp, Homo sapiens
tcgccagggcgtagggtgaat

SEQ ID NO: 3324 - DNA, 21 bp, Homo sapiens
atttgaatgggagttggcacc

SEQ ID NO: 3325 - DNA, 21 bp, Homo sapiens
gaactgacctcgctgctgatg

SEQ ID NO: 3326 - DNA, 21 bp, Homo sapiens
ggcacacagcggcctggcagt

SEQ ID NO: 3327 - DNA, 21 bp, Homo sapiens
gtgcctgaaccgcctgcaaca

SEQ ID NO: 3328 - DNA, 21 bp, Homo sapiens
attttatgtcgtccatttggc

SEQ ID NO: 3329 - DNA, 21 bp, Homo sapiens
gatcctgctcgttccccagcg

SEQ ID NO: 3330 - DNA, 21 bp, Homo sapiens
cttctgggccgaggccaacag

SEQ ID NO: 3331 - DNA, 21 bp, Homo sapiens
atcttggaaacggccaaagga

SEQ ID NO: 3332 - DNA, 21 bp, Homo sapiens
caccgtgcccgcgcctggcgc

SEQ ID NO: 3333 - DNA, 21 bp, Homo sapiens
agggaacgccgcggatcctag

SEQ ID NO: 3334 - DNA, 21 bp, Homo sapiens
ggcagtggagggcctggccta

SEQ ID NO: 3335 - DNA, 21 bp, Homo sapiens
ctgctactcttctgctgtggc

SEQ ID NO: 3336 - DNA, 21 bp, Homo sapiens
ttgagctcccgttccaggatg

SEQ ID NO: 3337 - DNA, 21 bp, Homo sapiens
ggccacaaacgacatggcagt

SEQ ID NO: 3338 - DNA, 21 bp, Homo sapiens
catgaaacaaatgaatgatgc

SEQ ID NO: 3339 - DNA, 21 bp, Homo sapiens
cacctgtgtcgccaccaacat

SEQ ID NO: 3340 - DNA, 21 bp, Homo sapiens
gggacttcctgccacccaaga

SEQ ID NO: 3341 - DNA, 21 bp, Homo sapiens
acctgcagaacgggctgccaa

SEQ ID NO: 3342 - DNA, 21 bp, Homo sapiens
acagccttatctccaaactct

SEQ ID NO: 3343 - DNA, 21 bp, Homo sapiens
taaatacatcttcttgagtaa

SEQ ID NO: 3344 - DNA, 21 bp, Homo sapiens
ctcacctaactggctggttgt

SEQ ID NO: 3345 - DNA, 21 bp, Homo sapiens
gtccttcaccgtggttttcca

SEQ ID NO: 3346 - DNA, 21 bp, Homo sapiens
ggcccacaaccgcatcacagc

SEQ ID NO: 3347 - DNA, 21 bp, Homo sapiens
aaggtacttcgcagggattct

SEQ ID NO: 3348 - DNA, 21 bp, Homo sapiens
ctgcattaaatgatcactcaa

SEQ ID NO: 3349 - DNA, 21 bp, Homo sapiens
tgagcctgccgaatttcattc

SEQ ID NO: 3350 - DNA, 21 bp, Homo sapiens
gcccactggcccactgcctgg

SEQ ID NO: 3351 - DNA, 21 bp, Homo sapiens
ttcttggcccccttttttttg

SEQ ID NO: 3352 - DNA, 21 bp, Homo sapiens
gcatggtgcaattctacttgt

SEQ ID NO: 3353 - DNA, 21 bp, Homo sapiens
agtgcataagtaaaaaaggga

SEQ ID NO: 3354 - DNA, 21 bp, Homo sapiens
ggacacctcttgctacaggtg

SEQ ID NO: 3355 - DNA, 21 bp, Homo sapiens
tgccctgcaggaacttcttct

SEQ ID NO: 3356 - DNA, 21 bp, Homo sapiens
gcatatgatccgtgaacacag

SEQ ID NO: 3357 - DNA, 21 bp, Homo sapiens
aggagttatagctccgttcca

SEQ ID NO: 3358 - DNA, 21 bp, Homo sapiens
tctttggtatgacttctatag

SEQ ID NO: 3359 - DNA, 21 bp, Homo sapiens
atacacagggcgtccacgtca

SEQ ID NO: 3360 - DNA, 21 bp, Homo sapiens
aaacaaaatccgagtggactg

SEQ ID NO: 3361 - DNA, 21 bp, Homo sapiens
agcttcggatacagagtcggc

SEQ ID NO: 3362 - DNA, 21 bp, Homo sapiens
catcagccaggagagctgtga

SEQ ID NO: 3363 - DNA, 21 bp, Homo sapiens
tcggtccagtagagttttctt

SEQ ID NO: 3364 - DNA, 21 bp, Homo sapiens
cctcccattcgtgctaaaatc

SEQ ID NO: 3365 - DNA, 21 bp, Homo sapiens
ggagaagcccgtcaccaagga

SEQ ID NO: 3366 - DNA, 21 bp, Homo sapiens
aatagtccgcgtgggcgacga

SEQ ID NO: 3367 - DNA, 22 bp, Homo sapiens
tcagtggctgctggctctcctc

SEQ ID NO: 3368 - DNA, 21 bp, Homo sapiens
caaggcagtggacgaggctgt

SEQ ID NO: 3369 - DNA, 21 bp, Homo sapiens
gcacgttggcgcaattcctgc

SEQ ID NO: 3370 - DNA, 21 bp, Homo sapiens
cagccatggacgccctccctg

SEQ ID NO: 3371 - DNA, 21 bp, Homo sapiens
ggggccggcccggcctggaag

SEQ ID NO: 3372 - DNA, 21 bp, Homo sapiens
cccgccattccttcaggttct

SEQ ID NO: 3373 - DNA, 21 bp, Homo sapiens
ctggaagtaagcacgaagcca

SEQ ID NO: 3374 - DNA, 21 bp, Homo sapiens
ttggtcttatcatcttttgct

SEQ ID NO: 3375 - DNA, 21 bp, Homo sapiens
caacaattcctgttgactcca

SEQ ID NO: 3376 - DNA, 21 bp, Homo sapiens
catctttgtcgcagccccttt

SEQ ID NO: 3377 - DNA, 21 bp, Homo sapiens
ggtgatattccatcactatta

SEQ ID NO: 3378 - DNA, 21 bp, Homo sapiens
tagaaattatgtacacgtagg

SEQ ID NO: 3379 - DNA, 21 bp, Homo sapiens
aagacacttatggatttgttc

SEQ ID NO: 3380 - DNA, 21 bp, Homo sapiens
aaaaagagttgggcagcgaga

SEQ ID NO: 3381 - DNA, 21 bp, Homo sapiens
agaggtgctgatccccccctt

SEQ ID NO: 3382 - DNA, 21 bp, Homo sapiens
acgacaaagtcaaactgctgg

SEQ ID NO: 3383 - DNA, 21 bp, Homo sapiens
ttcttggcccggttggcgtag

SEQ ID NO: 3384 - DNA, 21 bp, Homo sapiens
catctctgctgtcgatggctt

SEQ ID NO: 3385 - DNA, 21 bp, Homo sapiens
gctgccagggcgtcgctgcgg

SEQ ID NO: 3386 - DNA, 21 bp, Homo sapiens
tgtgggaggtggcactggtgg

SEQ ID NO: 3387 - DNA, 21 bp, Homo sapiens
tatctcacagtgtaaaaaata

SEQ ID NO: 3388 - DNA, 20 bp, Homo sapiens
actcatggcaggtcccctgt

SEQ ID NO: 3389 - DNA, 21 bp, Homo sapiens
catgggatgacgcagcctgtc

SEQ ID NO: 3390 - DNA, 20 bp, Homo sapiens
ctccaccggcggttacagca

SEQ ID NO: 3391 - DNA, 21 bp, Homo sapiens
ggacagtgatccccccacagg

SEQ ID NO: 3392 - DNA, 21 bp, Homo sapiens
ggtcaatgacgttggaatcac

SEQ ID NO: 3393 - DNA, 21 bp, Homo sapiens
agacatcttctcaatgcccac

SEQ ID NO: 3394 - DNA, 21 bp, Homo sapiens
tttcctgcctattacgccatc

SEQ ID NO: 3395 - DNA, 21 bp, Homo sapiens
aaacgcttcaatggagacgtc

SEQ ID NO: 3396 - DNA, 21 bp, Homo sapiens
gagttccagacgctggagctg

SEQ ID NO: 3397 - DNA, 21 bp, Homo sapiens
cactgggacccactcaggggt

SEQ ID NO: 3398 - DNA, 21 bp, Homo sapiens
cagactttaccgccagaggac

SEQ ID NO: 3399 - DNA, 23 bp, Homo sapiens
aaatggcaggtatgatgattgca

SEQ ID NO: 3400 - DNA, 21 bp, Homo sapiens
ataacactaactcattgacct

SEQ ID NO: 3401 - DNA, 21 bp, Homo sapiens
ttgcaggagaggagttcatta

SEQ ID NO: 3402 - DNA, 21 bp, Homo sapiens
tccaggcggagttccccctgg

SEQ ID NO: 3403 - DNA, 21 bp, Homo sapiens
gagaaatctcgtgcccaaacc

SEQ ID NO: 3404 - DNA, 21 bp, Homo sapiens
ttcttttgtcgcagggctcaa

SEQ ID NO: 3405 - DNA, 21 bp, Homo sapiens
cacgcagcttcccctccagct

SEQ ID NO: 3406 - DNA, 21 bp, Homo sapiens
tggacaatgcgctctggagat

SEQ ID NO: 3407 - DNA, 21 bp, Homo sapiens
atattggactgtgtacatgtg

SEQ ID NO: 3408 - DNA, 21 bp, Homo sapiens
atagaagacaaatcagagcca

SEQ ID NO: 3409 - DNA, 20 bp, Homo sapiens
agcagtggcaggccagcggt

SEQ ID NO: 3410 - DNA, 21 bp, Homo sapiens
cagtatgcaatttctgatgtc

SEQ ID NO: 3411 - DNA, 21 bp, Homo sapiens
ctgaagacccctcctctggat

SEQ ID NO: 3412 - DNA, 21 bp, Homo sapiens
gcagaatttcagcaggaggct

SEQ ID NO: 3413 - DNA, 21 bp, Homo sapiens
cctccagggcgcgcaccttct

SEQ ID NO: 3414 - DNA, 21 bp, Homo sapiens
taacgccattcacggctgtgg

SEQ ID NO: 3415 - DNA, 21 bp, Homo sapiens
tcttcaacctcgctgtggctg

SEQ ID NO: 3416 - DNA, 21 bp, Homo sapiens
acccctagacctgtctgcagg

SEQ ID NO: 3417 - DNA, 21 bp, Homo sapiens
tctttctaatcctttggtgcc

SEQ ID NO: 3418 - DNA, 21 bp, Homo sapiens
cgccccttcctgggggctgcc

SEQ ID NO: 3419 - DNA, 21 bp, Homo sapiens
accactgggcccagctcggga

SEQ ID NO: 3420 - DNA, 21 bp, Homo sapiens
aagacatccggtgcctctagc

SEQ ID NO: 3421 - DNA, 21 bp, Homo sapiens
cagccatcaacgacggcagga

SEQ ID NO: 3422 - DNA, 21 bp, Homo sapiens
ggaatctggacgctgctcagc

SEQ ID NO: 3423 - DNA, 21 bp, Homo sapiens
atgttgttgcggcgctcacag

SEQ ID NO: 3424 - DNA, 21 bp, Homo sapiens
aaagattcaggaaataaggta

SEQ ID NO: 3425 - DNA, 21 bp, Homo sapiens
catttctcttgaacaatgcca

SEQ ID NO: 3426 - DNA, 21 bp, Homo sapiens
ccgccgcaccgcccggctcct

SEQ ID NO: 3427 - DNA, 23 bp, Homo sapiens
agacaaaccagccaagccatttt

SEQ ID NO: 3428 - DNA, 21 bp, Homo sapiens
cttatccagctgagaaagacg

SEQ ID NO: 3429 - DNA, 21 bp, Homo sapiens
ccctgggctccacctccactt

SEQ ID NO: 3430 - DNA, 21 bp, Homo sapiens
tcgaagtggcgcggctggacg

SEQ ID NO: 3431 - DNA, 21 bp, Homo sapiens
cccctccaccgccccctccag

SEQ ID NO: 3432 - DNA, 21 bp, Homo sapiens
catgggaaaccccctggacaa

SEQ ID NO: 3433 - DNA, 21 bp, Homo sapiens
ttttggattcaagcttgccag

SEQ ID NO: 3434 - DNA, 21 bp, Homo sapiens
cttcgtgcaggtcctgcagga

SEQ ID NO: 3435 - DNA, 21 bp, Homo sapiens
ggatacgattatcctggaaaa

SEQ ID NO: 3436 - DNA, 21 bp, Homo sapiens
agcctcacccgcttaacggac

SEQ ID NO: 3437 - DNA, 21 bp, Homo sapiens
gtctgattgacgcacaatatg

SEQ ID NO: 3438 - DNA, 21 bp, Homo sapiens
ctagttacaacgggtcaagag

SEQ ID NO: 3439 - DNA, 21 bp, Homo sapiens
gctaaagagccgtttgtacca

SEQ ID NO: 3440 - DNA, 21 bp, Homo sapiens
tgtctcaaatgtaggtcgttc

SEQ ID NO: 3441 - DNA, 21 bp, Homo sapiens
accaccaccaccatatcctgg

SEQ ID NO: 3442 - DNA, 21 bp, Homo sapiens
tgagccagttcggagctgctg

SEQ ID NO: 3443 - DNA, 21 bp, Homo sapiens
tcatcctggggtatttccttg

SEQ ID NO: 3444 - DNA, 21 bp, Homo sapiens
cctcatctcccggcgtgatgt

SEQ ID NO: 3445 - DNA, 21 bp, Homo sapiens
cagctctaccgtctgtgttgg

SEQ ID NO: 3446 - DNA, 21 bp, Homo sapiens
attcttcctcgtatagacttc

SEQ ID NO: 3447 - DNA, 21 bp, Homo sapiens
aactcctgagcaaatagagaa

SEQ ID NO: 3448 - DNA, 21 bp, Homo sapiens
gcttgtagcaataagaaccta

SEQ ID NO: 3449 - DNA, 21 bp, Homo sapiens
tgtggatggacggcacatata

SEQ ID NO: 3450 - DNA, 21 bp, Homo sapiens
tttcaatggcggccagatggg

SEQ ID NO: 3451 - DNA, 21 bp, Homo sapiens
tggccttcttgttctttcttc

SEQ ID NO: 3452 - DNA, 21 bp, Homo sapiens
ggggtttgttaaagttgttaa

SEQ ID NO: 3453 - DNA, 21 bp, Homo sapiens
ttgctcaaaaaattcacatag

SEQ ID NO: 3454 - DNA, 21 bp, Homo sapiens
ctccagctccgtcagccagtt

SEQ ID NO: 3455 - DNA, 21 bp, Homo sapiens
tgtgggggaaggtcgaagcgg

SEQ ID NO: 3456 - DNA, 21 bp, Homo sapiens
cagcatggccgcgtccaccat

SEQ ID NO: 3457 - DNA, 21 bp, Homo sapiens
gtgattaggtgtacacttcct

SEQ ID NO: 3458 - DNA, 21 bp, Homo sapiens
ttcttatcaaagaaatcctat

SEQ ID NO: 3459 - DNA, 21 bp, Homo sapiens
cttacagatatccattaaatt

SEQ ID NO: 3460 - DNA, 21 bp, Homo sapiens
gacaagatccctttcattcga

SEQ ID NO: 3461 - DNA, 21 bp, Homo sapiens
ttttctgtcacgctcttggcg

SEQ ID NO: 3462 - DNA, 21 bp, Homo sapiens
ttgttgctgcggaggtaccat

SEQ ID NO: 3463 - DNA, 21 bp, Homo sapiens
gccctcgctgcgcctcaaaag

SEQ ID NO: 3464 - DNA, 21 bp, Homo sapiens
aggccgagttcaaccgcatca

SEQ ID NO: 3465 - DNA, 21 bp, Homo sapiens
tgtacttttagcttgctggac

SEQ ID NO: 3466 - DNA, 21 bp, Homo sapiens
accttgcaaacgggtcagcca

SEQ ID NO: 3467 - DNA, 21 bp, Homo sapiens
agaggctctcgcggcgcgtgt

SEQ ID NO: 3468 - DNA, 21 bp, Homo sapiens
tgaaggcgtcttttacatctt

SEQ ID NO: 3469 - DNA, 21 bp, Homo sapiens
tggcatcatcgtcacccgagg

SEQ ID NO: 3470 - DNA, 21 bp, Homo sapiens
accaggtacaggatttatagg

SEQ ID NO: 3471 - DNA, 21 bp, Homo sapiens
tggcagcatactcccgtggat

SEQ ID NO: 3472 - DNA, 21 bp, Homo sapiens
aggcctgggccagctcctccc

SEQ ID NO: 3473 - DNA, 21 bp, Homo sapiens
tatgcctctacctgcgatttt

SEQ ID NO: 3474 - DNA, 23 bp, Homo sapiens
ctggcacctccttccagccactc

SEQ ID NO: 3475 - DNA, 21 bp, Homo sapiens
ctaatgatacgttggattctg

SEQ ID NO: 3476 - DNA, 21 bp, Homo sapiens
gccgcagagcgcgaagggttc

SEQ ID NO: 3477 - DNA, 21 bp, Homo sapiens
gaggcagggggagaagctttc

SEQ ID NO: 3478 - DNA, 21 bp, Homo sapiens
aggcagggggagaagctttct

SEQ ID NO: 3479 - DNA, 21 bp, Homo sapiens
ttgaacatcttctcatacact

SEQ ID NO: 3480 - DNA, 21 bp, Homo sapiens
cacctggggccctcaccccgc

SEQ ID NO: 3481 - DNA, 21 bp, Homo sapiens
tgggtgtggtcagcattctgg

SEQ ID NO: 3482 - DNA, 21 bp, Homo sapiens
aatttgcgtacgcacgtgcgc

SEQ ID NO: 3483 - DNA, 21 bp, Homo sapiens
cagaactagccaatacttttg

SEQ ID NO: 3484 - DNA, 21 bp, Homo sapiens
tgaagaaggcgatgaccacag

SEQ ID NO: 3485 - DNA, 21 bp, Homo sapiens
aagcggctggcgggcggcgac

SEQ ID NO: 3486 - DNA, 20 bp, Homo sapiens
cccagtggctgttcacagcc

SEQ ID NO: 3487 - DNA, 21 bp, Homo sapiens
gactgccatctgatagcaccc

SEQ ID NO: 3488 - DNA, 21 bp, Homo sapiens
agccaaagaagatcttaagaa

SEQ ID NO: 3489 - DNA, 21 bp, Homo sapiens
gacgaaagtaagtgcaatgga

SEQ ID NO: 3490 - DNA, 21 bp, Homo sapiens
ccacccacagcgttacttggt

SEQ ID NO: 3491 - DNA, 21 bp, Homo sapiens
ctttataatgtgtttgagcaa

SEQ ID NO: 3492 - DNA, 21 bp, Homo sapiens
tttataatgtgtttgagcaaa

SEQ ID NO: 3493 - DNA, 21 bp, Homo sapiens
tactacgcaatatagatggta

SEQ ID NO: 3494 - DNA, 21 bp, Homo sapiens
aggcgcctgacgctgatgtaa

SEQ ID NO: 3495 - DNA, 21 bp, Homo sapiens
gcacaggacccttccacgggc

SEQ ID NO: 3496 - DNA, 21 bp, Homo sapiens
gtcacagcatgtgtaatctcc

SEQ ID NO: 3497 - DNA, 21 bp, Homo sapiens
tctgcgccgcatgctgcccgt

SEQ ID NO: 3498 - DNA, 21 bp, Homo sapiens
ggatattggccctgggatgtg

SEQ ID NO: 3499 - DNA, 21 bp, Homo sapiens
gaaaatcatcggacatttcta

SEQ ID NO: 3500 - DNA, 21 bp, Homo sapiens
ccttaccctggcctctcgaca

SEQ ID NO: 3501 - DNA, 21 bp, Homo sapiens
aagccatgatcagtttgggga

SEQ ID NO: 3502 - DNA, 21 bp, Homo sapiens
attgtaaacacgctcctctaa

SEQ ID NO: 3503 - DNA, 21 bp, Homo sapiens
tcaccatccagcgtctccacc

SEQ ID NO: 3504 - DNA, 21 bp, Homo sapiens
atcctcgtcatggccctcagt

SEQ ID NO: 3505 - DNA, 21 bp, Homo sapiens
aaatcctttcggctctctggg

SEQ ID NO: 3506 - DNA, 21 bp, Homo sapiens
tggggactgtggccgtactta

SEQ ID NO: 3507 - DNA, 21 bp, Homo sapiens
caggagcaccaagtgttgctg

SEQ ID NO: 3508 - DNA, 21 bp, Homo sapiens
cctggtgctgttgctttgggg

SEQ ID NO: 3509 - DNA, 21 bp, Homo sapiens
caaggaggcgctcggagggtg

SEQ ID NO: 3510 - DNA, 21 bp, Homo sapiens
aaggaggcgctcggagggtga

SEQ ID NO: 3511 - DNA, 21 bp, Homo sapiens
agtcttctaagcttgtatggt

SEQ ID NO: 3512 - DNA, 23 bp, Homo sapiens
ggcgcagggactcaagccacaac

SEQ ID NO: 3513 - DNA, 21 bp, Homo sapiens
gacctgacaggggcaccttgc

SEQ ID NO: 3514 - DNA, 21 bp, Homo sapiens
gcagaggaaacgagttactca

SEQ ID NO: 3515 - DNA, 21 bp, Homo sapiens
cccaaattttccagaaaagaa

SEQ ID NO: 3516 - DNA, 21 bp, Homo sapiens
gaccagcaatggtgttgctct

SEQ ID NO: 3517 - DNA, 21 bp, Homo sapiens
accagcaatggtgttgctctg

SEQ ID NO: 3518 - DNA, 22 bp, Homo sapiens
ttgccactgaacgcattttcat

SEQ ID NO: 3519 - DNA, 21 bp, Homo sapiens
aaatcagcaaaaagaggagcc

SEQ ID NO: 3520 - DNA, 21 bp, Homo sapiens
gagcccaacgagatgatgcgg

SEQ ID NO: 3521 - DNA, 21 bp, Homo sapiens
ggatgaggcagaaaaggagca

SEQ ID NO: 3522 - DNA, 21 bp, Homo sapiens
cctacatttctgtttcaaaac

SEQ ID NO: 3523 - DNA, 21 bp, Homo sapiens
ccaagctgcagctctcagcac

SEQ ID NO: 3524 - DNA, 21 bp, Homo sapiens
cctgcttaccagccattttga

SEQ ID NO: 3525 - DNA, 21 bp, Homo sapiens
gctgaccacacttttgaaatc

SEQ ID NO: 3526 - DNA, 21 bp, Homo sapiens
catggcttgggtgtcaacacc

SEQ ID NO: 3527 - DNA, 21 bp, Homo sapiens
tccccattcctggggctctgg

SEQ ID NO: 3528 - DNA, 21 bp, Homo sapiens
ggtgctcctcgtagtgcagct

SEQ ID NO: 3529 - DNA, 21 bp, Homo sapiens
cagcactctgtaagtccttct

SEQ ID NO: 3530 - DNA, 21 bp, Homo sapiens
tttggaccaccgactacggag

SEQ ID NO: 3531 - DNA, 21 bp, Homo sapiens
agtagtggcggtcagggtggg

SEQ ID NO: 3532 - DNA, 21 bp, Homo sapiens
ggtgctccaggtcctgatgga

SEQ ID NO: 3533 - DNA, 21 bp, Homo sapiens
aatgcagtggctgtgagtttt

SEQ ID NO: 3534 - DNA, 21 bp, Homo sapiens
caagctcatacggcagcagca

SEQ ID NO: 3535 - DNA, 23 bp, Homo sapiens
gggtacccagttcttctttgtgt

SEQ ID NO: 3536 - DNA, 21 bp, Homo sapiens
ccatcaacaccaagcagcagt

SEQ ID NO: 3537 - DNA, 21 bp, Homo sapiens
acagactcacggagacatcct

SEQ ID NO: 3538 - DNA, 21 bp, Homo sapiens
gggggccccccgctaccagca

SEQ ID NO: 3539 - DNA, 21 bp, Homo sapiens
gctgggtgacgaaagtccaca

SEQ ID NO: 3540 - DNA, 21 bp, Homo sapiens
gggcggctgtgggagagccgc

SEQ ID NO: 3541 - DNA, 21 bp, Homo sapiens
ttttatggaccgaaaccagta

SEQ ID NO: 3542 - DNA, 21 bp, Homo sapiens
gggatagctcggggtgcagtg

SEQ ID NO: 3543 - DNA, 21 bp, Homo sapiens
gaaattaccacgaaacctgag

SEQ ID NO: 3544 - DNA, 21 bp, Homo sapiens
cagctgctccggggagggcgg

SEQ ID NO: 3545 - DNA, 21 bp, Homo sapiens
aggaacttcatgataccagtc

SEQ ID NO: 3546 - DNA, 21 bp, Homo sapiens
gctgctctccctcacagcctc

SEQ ID NO: 3547 - DNA, 21 bp, Homo sapiens
ggtaaccgcgcgggacggggg

SEQ ID NO: 3548 - DNA, 21 bp, Homo sapiens
gctttatttgaaaaaaaacaa

SEQ ID NO: 3549 - DNA, 21 bp, Homo sapiens
aggcccggcccgccacgccca

SEQ ID NO: 3550 - DNA, 21 bp, Homo sapiens
agaggagggtggaaatgaagg

SEQ ID NO: 3551 - DNA, 21 bp, Homo sapiens
gaactcatacctttacactgc

SEQ ID NO: 3552 - DNA, 21 bp, Homo sapiens
gcccatggaggaagagctgcc

SEQ ID NO: 3553 - DNA, 21 bp, Homo sapiens
tctgccactcgttgtttataa

SEQ ID NO: 3554 - DNA, 21 bp, Homo sapiens
tgggctcggcgccaggtggga

SEQ ID NO: 3555 - DNA, 21 bp, Homo sapiens
cctccgcctagggcgccaggt

SEQ ID NO: 3556 - DNA, 21 bp, Homo sapiens
tctaacaagggcacgagctat

SEQ ID NO: 3557 - DNA, 21 bp, Homo sapiens
aggtcagagcgctgcttctct

SEQ ID NO: 3558 - DNA, 21 bp, Homo sapiens
acagacacaagtaattttgac

SEQ ID NO: 3559 - DNA, 21 bp, Homo sapiens
cgacgggccgttgtggttcga

SEQ ID NO: 3560 - DNA, 21 bp, Homo sapiens
ctcctggcagcgcagctgctg

SEQ ID NO: 3561 - DNA, 21 bp, Homo sapiens
ctgtctcttccgcagcccttg

SEQ ID NO: 3562 - DNA, 21 bp, Homo sapiens
gagttggagcggtgccagcag

SEQ ID NO: 3563 - DNA, 21 bp, Homo sapiens
cgacacccactcctccacctt

SEQ ID NO: 3564 - DNA, 21 bp, Homo sapiens
agtacttccacacggagtccc

SEQ ID NO: 3565 - DNA, 21 bp, Homo sapiens
tcatacagccgcagctcacac

SEQ ID NO: 3566 - DNA, 21 bp, Homo sapiens
ccacgcgacacggtgcccaag

SEQ ID NO: 3567 - DNA, 21 bp, Homo sapiens
gaattaataaggtgctcaaac

SEQ ID NO: 3568 - DNA, 21 bp, Homo sapiens
gaccagcaaacaaaatggaag

SEQ ID NO: 3569 - DNA, 21 bp, Homo sapiens
atctacttacgtcatcaatat

SEQ ID NO: 3570 - DNA, 21 bp, Homo sapiens
ttgcacttgaggaaaaatttt

SEQ ID NO: 3571 - DNA, 21 bp, Homo sapiens
aaaattgccatcaataggttt

SEQ ID NO: 3572 - DNA, 21 bp, Homo sapiens
tcctggtgttcgccaccttcc

SEQ ID NO: 3573 - DNA, 21 bp, Homo sapiens
cttagctacaatgactgcatt

SEQ ID NO: 3574 - DNA, 21 bp, Homo sapiens
caccctcggtcctgaccacgg

SEQ ID NO: 3575 - DNA, 21 bp, Homo sapiens
tgtccgtctgcagctcggcaa

SEQ ID NO: 3576 - DNA, 21 bp, Homo sapiens
agcggccagcgtccaccccgg

SEQ ID NO: 3577 - DNA, 21 bp, Homo sapiens
agagcattgcggctgtacttc

SEQ ID NO: 3578 - DNA, 21 bp, Homo sapiens
cacaagtcagcgcattaaagt

SEQ ID NO: 3579 - DNA, 21 bp, Homo sapiens
gccccacaaccgctggaggac

SEQ ID NO: 3580 - DNA, 21 bp, Homo sapiens
ttgctgacactgttgtaggtc

SEQ ID NO: 3581 - DNA, 21 bp, Homo sapiens
caaaaatcttcgagcttgctg

SEQ ID NO: 3582 - DNA, 21 bp, Homo sapiens
gtggtcctggcggagaagagg

SEQ ID NO: 3583 - DNA, 20 bp, Homo sapiens
tactaatggcttccccacat

SEQ ID NO: 3584 - DNA, 21 bp, Homo sapiens
ataagcatgacgacctatgat

SEQ ID NO: 3585 - DNA, 21 bp, Homo sapiens
tgctgacaaagtggccaccgt

SEQ ID NO: 3586 - DNA, 21 bp, Homo sapiens
caccagtcccgatgtcagtag

SEQ ID NO: 3587 - DNA, 21 bp, Homo sapiens
tcttccagcactgatgttggc

SEQ ID NO: 3588 - DNA, 21 bp, Homo sapiens
atatttacctagaactgatgg

SEQ ID NO: 3589 - DNA, 21 bp, Homo sapiens
cggggaagaacggcggctggt

SEQ ID NO: 3590 - DNA, 21 bp, Homo sapiens
atgtccagctcgatccggaac

SEQ ID NO: 3591 - DNA, 21 bp, Homo sapiens
atagctctccggttttacagg

SEQ ID NO: 3592 - DNA, 21 bp, Homo sapiens
agtaaagattcaagaggaatc

SEQ ID NO: 3593 - DNA, 21 bp, Homo sapiens
ccatgagggcgacctcagtaa

SEQ ID NO: 3594 - DNA, 21 bp, Homo sapiens
tatccgctcacggaaaaagtg

SEQ ID NO: 3595 - DNA, 21 bp, Homo sapiens
atgggagcccggggtcctcca

SEQ ID NO: 3596 - DNA, 21 bp, Homo sapiens
cggcagctatttccacatggc

SEQ ID NO: 3597 - DNA, 21 bp, Homo sapiens
tcagaagaaatggctcaaagg

SEQ ID NO: 3598 - DNA, 21 bp, Homo sapiens
acccgccgccgtcccacgcct

SEQ ID NO: 3599 - DNA, 21 bp, Homo sapiens
ataaagtaaacgacattgtag

SEQ ID NO: 3600 - DNA, 21 bp, Homo sapiens
agaagtacgagattataaaag

SEQ ID NO: 3601 - DNA, 22 bp, Homo sapiens
atcgggaagactctgtcagtct

SEQ ID NO: 3602 - DNA, 21 bp, Homo sapiens
atataggaagaaaatgtggcc

SEQ ID NO: 3603 - DNA, 21 bp, Homo sapiens
caagagtcttgggggtaagtc

SEQ ID NO: 3604 - DNA, 21 bp, Homo sapiens
cagcctgtcagatgctgccgg

SEQ ID NO: 3605 - DNA, 21 bp, Homo sapiens
ccaggtcttcgtcctcctgtg

SEQ ID NO: 3606 - DNA, 21 bp, Homo sapiens
agacgaagacgtcgtccttgg

SEQ ID NO: 3607 - DNA, 21 bp, Homo sapiens
aaggtctacgtagacaagctt

SEQ ID NO: 3608 - DNA, 21 bp, Homo sapiens
gggcttgggagtctccactgt

SEQ ID NO: 3609 - DNA, 21 bp, Homo sapiens
tataataatcgtgagcgtttg

SEQ ID NO: 3610 - DNA, 21 bp, Homo sapiens
acatcaccacgttgtctgcag

SEQ ID NO: 3611 - DNA, 21 bp, Homo sapiens
ggctggctgcgactgtcgctg

SEQ ID NO: 3612 - DNA, 21 bp, Homo sapiens
tattcggtggcctgtctccgg

SEQ ID NO: 3613 - DNA, 21 bp, Homo sapiens
gttcctgcaccggaaaccacc

SEQ ID NO: 3614 - DNA, 21 bp, Homo sapiens
tttgttctctcgcttcagggt

SEQ ID NO: 3615 - DNA, 21 bp, Homo sapiens
aaaaatcctcctatgtaggag

SEQ ID NO: 3616 - DNA, 21 bp, Homo sapiens
gcttatggcaagaagtgaaga

SEQ ID NO: 3617 - DNA, 21 bp, Homo sapiens
tcctgcaggcgtctctccaag

SEQ ID NO: 3618 - DNA, 21 bp, Homo sapiens
atggtgacaacgatagttttc

SEQ ID NO: 3619 - DNA, 21 bp, Homo sapiens
actgacagacgtctggaaatg

SEQ ID NO: 3620 - DNA, 21 bp, Homo sapiens
ttaacagaggaagcgagagaa

SEQ ID NO: 3621 - DNA, 21 bp, Homo sapiens
cgcctcccgccgagtgggcct

SEQ ID NO: 3622 - DNA, 21 bp, Homo sapiens
gatgttgctcgattttagagg

SEQ ID NO: 3623 - DNA, 21 bp, Homo sapiens
gctgcatactgctggaactgc

SEQ ID NO: 3624 - DNA, 21 bp, Homo sapiens
tggggacttacgaattcgttg

SEQ ID NO: 3625 - DNA, 21 bp, Homo sapiens
agcagtggctgtccactgacg

SEQ ID NO: 3626 - DNA, 21 bp, Homo sapiens
cccctcagtgctccagctgca

SEQ ID NO: 3627 - DNA, 21 bp, Homo sapiens
ttgacgtcaacggaatcgcta

SEQ ID NO: 3628 - DNA, 21 bp, Homo sapiens
ccgggatgacgtggccttgaa

SEQ ID NO: 3629 - DNA, 21 bp, Homo sapiens
aacagaacagcgaaagtattg

SEQ ID NO: 3630 - DNA, 21 bp, Homo sapiens
ggcatcgcacggtagttttgc

SEQ ID NO: 3631 - DNA, 21 bp, Homo sapiens
agtgagcacccgtgggctcat

SEQ ID NO: 3632 - DNA, 21 bp, Homo sapiens
aacaaaggtaccttctggatg

SEQ ID NO: 3633 - DNA, 21 bp, Homo sapiens
acagcgccttcatggagccga

SEQ ID NO: 3634 - DNA, 21 bp, Homo sapiens
tagtgcaaccaccaccactac

SEQ ID NO: 3635 - DNA, 21 bp, Homo sapiens
atgcggcccacggcctcgaac

SEQ ID NO: 3636 - DNA, 21 bp, Homo sapiens
aggatcctgcgtcctccaggg

SEQ ID NO: 3637 - DNA, 21 bp, Homo sapiens
aagaaagcacagagtcttgct

SEQ ID NO: 3638 - DNA, 21 bp, Homo sapiens
tcatccctgcgtggaccgagg

SEQ ID NO: 3639 - DNA, 21 bp, Homo sapiens
tattcccacagtgtatcggct

SEQ ID NO: 3640 - DNA, 21 bp, Homo sapiens
ggccatggcgcggacgcgggt

SEQ ID NO: 3641 - DNA, 21 bp, Homo sapiens
tccgtatttgcggaaaattcg

SEQ ID NO: 3642 - DNA, 21 bp, Homo sapiens
aggctgcccccgagcccgagg

SEQ ID NO: 3643 - DNA, 21 bp, Homo sapiens
tgacttgtaccgaagtgggaa

SEQ ID NO: 3644 - DNA, 21 bp, Homo sapiens
cccaacgaatgcccactgggg

SEQ ID NO: 3645 - DNA, 21 bp, Homo sapiens
actcagcattgttcttaaagg

SEQ ID NO: 3646 - DNA, 21 bp, Homo sapiens
agggtcagggccactggtcgc

SEQ ID NO: 3647 - DNA, 21 bp, Homo sapiens
aacactgttagctttacatct

SEQ ID NO: 3648 - DNA, 21 bp, Homo sapiens
tcacgcccgatgtcgtgcacc

SEQ ID NO: 3649 - DNA, 21 bp, Homo sapiens
ttgtgccaccatgctgtgttc

SEQ ID NO: 3650 - DNA, 21 bp, Homo sapiens
gcccaaccccgtcttcaggga

SEQ ID NO: 3651 - DNA, 21 bp, Homo sapiens
actgcatccggtggggggccg

SEQ ID NO: 3652 - DNA, 21 bp, Homo sapiens
agataaagtcgttccaacttc

SEQ ID NO: 3653 - DNA, 21 bp, Homo sapiens
tgaggactgccacgtgactgt

SEQ ID NO: 3654 - DNA, 21 bp, Homo sapiens
ccgacatttccacactcgccg

SEQ ID NO: 3655 - DNA, 21 bp, Homo sapiens
tgccaaaaccccatctacatg

SEQ ID NO: 3656 - DNA, 22 bp, Homo sapiens
cgcttcatgcttcgcctgccga

SEQ ID NO: 3657 - DNA, 21 bp, Homo sapiens
tcctcaatctcgctgtacttt

SEQ ID NO: 3658 - DNA, 21 bp, Homo sapiens
taagcatgacgacctatgatg

SEQ ID NO: 3659 - DNA, 21 bp, Homo sapiens
gcattcagacgggcacggaag

SEQ ID NO: 3660 - DNA, 21 bp, Homo sapiens
actacaccatcttttaccaag

SEQ ID NO: 3661 - DNA, 21 bp, Homo sapiens
ttttcacctgcagaaactcat

SEQ ID NO: 3662 - DNA, 21 bp, Homo sapiens
gaaaagtggcgtctgtgcctt

SEQ ID NO: 3663 - DNA, 21 bp, Homo sapiens
gaaacagaacgcagctgccca

SEQ ID NO: 3664 - DNA, 21 bp, Homo sapiens
ttactgttacgtttgaaatga

SEQ ID NO: 3665 - DNA, 22 bp, Homo sapiens
gaggcagcacagctgccatgat

SEQ ID NO: 3666 - DNA, 21 bp, Homo sapiens
caaaactatcgaagcgcaggt

SEQ ID NO: 3667 - DNA, 21 bp, Homo sapiens
tggagtcagatgacaccatgc

SEQ ID NO: 3668 - DNA, 21 bp, Homo sapiens
cgtcaggtgccgactgtccac

SEQ ID NO: 3669 - DNA, 21 bp, Homo sapiens
ctgctataccagtggatcctg

SEQ ID NO: 3670 - DNA, 21 bp, Homo sapiens
cgcagggtggggaaatggaag

SEQ ID NO: 3671 - DNA, 21 bp, Homo sapiens
ccttccactcggagttcccag

SEQ ID NO: 3672 - DNA, 21 bp, Homo sapiens
actgcttgtagatgactttgc

SEQ ID NO: 3673 - DNA, 21 bp, Homo sapiens
atcagtcggcgaataccgtaa

SEQ ID NO: 3674 - DNA, 21 bp, Homo sapiens
ttgagttggtccctctcaatt

SEQ ID NO: 3675 - DNA, 21 bp, Homo sapiens
ttcatggatagcaaagcctag

SEQ ID NO: 3676 - DNA, 21 bp, Homo sapiens
cctctccagcgtctttgctct

SEQ ID NO: 3677 - DNA, 21 bp, Homo sapiens
gttaggcatactcttctcagg

SEQ ID NO: 3678 - DNA, 21 bp, Homo sapiens
gaatctctctcgaagtaagtt

SEQ ID NO: 3679 - DNA, 21 bp, Homo sapiens
tatttcttgcaatgaaattcc

SEQ ID NO: 3680 - DNA, 21 bp, Homo sapiens
gccacccatcgttctggaggg

SEQ ID NO: 3681 - DNA, 21 bp, Homo sapiens
acatccactgcaagagactct

SEQ ID NO: 3682 - DNA, 21 bp, Homo sapiens
tccaaatattctaaatcctgg

SEQ ID NO: 3683 - DNA, 21 bp, Homo sapiens
aagagcacacgcacaagcgat

SEQ ID NO: 3684 - DNA, 21 bp, Homo sapiens
gcagagccacgagtgtgaagg

SEQ ID NO: 3685 - DNA, 21 bp, Homo sapiens
tgccaacgacgctgacctttg

SEQ ID NO: 3686 - DNA, 21 bp, Homo sapiens
ccctgctggcgctgcgccatg

SEQ ID NO: 3687 - DNA, 21 bp, Homo sapiens
tccttcaggccttcgatctgc

SEQ ID NO: 3688 - DNA, 21 bp, Homo sapiens
cctcatcttttatagagatgg

SEQ ID NO: 3689 - DNA, 21 bp, Homo sapiens
cctgagaaggcactgcacggc

SEQ ID NO: 3690 - DNA, 21 bp, Homo sapiens
gtataggtgaaacttgcaaaa

SEQ ID NO: 3691 - DNA, 21 bp, Homo sapiens
agccggagcatggggcctatt

SEQ ID NO: 3692 - DNA, 21 bp, Homo sapiens
cacccgccctcccccgctgcg

SEQ ID NO: 3693 - DNA, 21 bp, Homo sapiens
aggcaatagcgcctttaagtc

SEQ ID NO: 3694 - DNA, 21 bp, Homo sapiens
atagatccagtggagattctc

SEQ ID NO: 3695 - DNA, 21 bp, Homo sapiens
acatccttcgaaaagctgcca

SEQ ID NO: 3696 - DNA, 21 bp, Homo sapiens
tgaaatctcaagagggtcaag

SEQ ID NO: 3697 - DNA, 21 bp, Homo sapiens
aaccacaatccgcctcacctg

SEQ ID NO: 3698 - DNA, 22 bp, Homo sapiens
cagtggcaggaagggccagtcg

SEQ ID NO: 3699 - DNA, 21 bp, Homo sapiens
gggagccctggaaccgggccc

SEQ ID NO: 3700 - DNA, 21 bp, Homo sapiens
tatggctctcggacctggggc

SEQ ID NO: 3701 - DNA, 21 bp, Homo sapiens
cttggctgaacgcccagttgc

SEQ ID NO: 3702 - DNA, 21 bp, Homo sapiens
taaaaagaaagaccttcatca

SEQ ID NO: 3703 - DNA, 22 bp, Homo sapiens
ctactgtggctgcagccactgg

SEQ ID NO: 3704 - DNA, 20 bp, Homo sapiens
aactatggcaggaaaatgca

SEQ ID NO: 3705 - DNA, 21 bp, Homo sapiens
ggaacggaccgggacactaac

SEQ ID NO: 3706 - DNA, 21 bp, Homo sapiens
ggtaagaggcgtcttcgggat

SEQ ID NO: 3707 - DNA, 21 bp, Homo sapiens
cctctgcaccgaccgcgtgaa

SEQ ID NO: 3708 - DNA, 21 bp, Homo sapiens
tggctgtatcgcggtgagagg

SEQ ID NO: 3709 - DNA, 21 bp, Homo sapiens
attgcactcacgtgaggagga

SEQ ID NO: 3710 - DNA, 21 bp, Homo sapiens
catttatagggtttctctcca

SEQ ID NO: 3711 - DNA, 21 bp, Homo sapiens
ggtcagctcccggggggtgcc

SEQ ID NO: 3712 - DNA, 21 bp, Homo sapiens
tgaaatcattccagtgctcct

SEQ ID NO: 3713 - DNA, 21 bp, Homo sapiens
taggaacaccgttttggatgg

SEQ ID NO: 3714 - DNA, 21 bp, Homo sapiens
tgatataaaacgtaaattagt

SEQ ID NO: 3715 - DNA, 21 bp, Homo sapiens
aagacatccggtgcctctagc

SEQ ID NO: 3716 - DNA, 21 bp, Homo sapiens
gaagcatcaaaagcgctgtaa

SEQ ID NO: 3717 - DNA, 21 bp, Homo sapiens
aataggacctcgttttgtctt

SEQ ID NO: 3718 - DNA, 21 bp, Homo sapiens
caccagtgggcggagaagccc

SEQ ID NO: 3719 - DNA, 22 bp, Homo sapiens
ggggcgctccggctgccgtacc

SEQ ID NO: 3720 - DNA, 21 bp, Homo sapiens
tgaggttgtgcatgcggtttc

SEQ ID NO: 3721 - DNA, 21 bp, Homo sapiens
tgactctgtagctcttttagc

SEQ ID NO: 3722 - DNA, 21 bp, Homo sapiens
aaggaatcctttacacttagc

SEQ ID NO: 3723 - DNA, 21 bp, Homo sapiens
ccagcccttcgaatactttgt

SEQ ID NO: 3724 - DNA, 21 bp, Homo sapiens
ctctggtagaggggtgttcag

SEQ ID NO: 3725 - DNA, 21 bp, Homo sapiens
gtactacgccgaatgggggtg

SEQ ID NO: 3726 - DNA, 21 bp, Homo sapiens
ggggccccacgtcctgcttct

SEQ ID NO: 3727 - DNA, 21 bp, Homo sapiens
cacacatctcgaagcacatct

SEQ ID NO: 3728 - DNA, 21 bp, Homo sapiens
ctgagcccaacactctggaag

SEQ ID NO: 3729 - DNA, 21 bp, Homo sapiens
acacaactctgtccagcccac

SEQ ID NO: 3730 - DNA, 21 bp, Homo sapiens
tgccggcaccgctctagctcc

SEQ ID NO: 3731 - DNA, 21 bp, Homo sapiens
catgcaccgatgtactcctgg

SEQ ID NO: 3732 - DNA, 21 bp, Homo sapiens
atgatggctcttgttgctgag

SEQ ID NO: 3733 - DNA, 21 bp, Homo sapiens
tagctcctccctgctatatgg

SEQ ID NO: 3734 - DNA, 21 bp, Homo sapiens
acactacgcttatgcctggat

SEQ ID NO: 3735 - DNA, 21 bp, Homo sapiens
gcgcacggacgtggtcctggc

SEQ ID NO: 3736 - DNA, 21 bp, Homo sapiens
tcatcctggggtatttccttg

SEQ ID NO: 3737 - DNA, 21 bp, Homo sapiens
catttctcaccgccttccaga

SEQ ID NO: 3738 - DNA, 21 bp, Homo sapiens
ttcccgctggcgccgccgccg

SEQ ID NO: 3739 - DNA, 21 bp, Homo sapiens
taaagccctgtggtgccatcg

SEQ ID NO: 3740 - DNA, 21 bp, Homo sapiens
cgttcaaaatgtctttaagaa

SEQ ID NO: 3741 - DNA, 21 bp, Homo sapiens
agggtccctgccaggcggatg

SEQ ID NO: 3742 - DNA, 23 bp, Homo sapiens
cagccagtccttcagttcgcctg

SEQ ID NO: 3743 - DNA, 21 bp, Homo sapiens
gaaatccagcagatcgtttaa

SEQ ID NO: 3744 - DNA, 21 bp, Homo sapiens
cactcctgccgccaccttccc

SEQ ID NO: 3745 - DNA, 21 bp, Homo sapiens
caacaacttcggagtgctctt

SEQ ID NO: 3746 - DNA, 21 bp, Homo sapiens
caaagcaccggccgagcgcga

SEQ ID NO: 3747 - DNA, 21 bp, Homo sapiens
gggtggacttttctcctgtgg

SEQ ID NO: 3748 - DNA, 21 bp, Homo sapiens
gcccgcgccccccgcctcccc

SEQ ID NO: 3749 - DNA, 21 bp, Homo sapiens
ctcttccgaacccaccaacgc

SEQ ID NO: 3750 - DNA, 21 bp, Homo sapiens
gatggcacacgagctcagtcc

SEQ ID NO: 3751 - DNA, 21 bp, Homo sapiens
atcccttacccgccggggaca

SEQ ID NO: 3752 - DNA, 21 bp, Homo sapiens
tgaaatatacgttgatggcaa

SEQ ID NO: 3753 - DNA, 21 bp, Homo sapiens
acagtgcagcgcggcctatga

SEQ ID NO: 3754 - DNA, 21 bp, Homo sapiens
cccgcacctgcccctcgcctc

SEQ ID NO: 3755 - DNA, 21 bp, Homo sapiens
caaagggtaacgagatgcctt

SEQ ID NO: 3756 - DNA, 21 bp, Homo sapiens
aacgtgacgcgttgccacacc

SEQ ID NO: 3757 - DNA, 21 bp, Homo sapiens
gtacactgcagagttgtaagt

SEQ ID NO: 3758 - DNA, 21 bp, Homo sapiens
tgcaccccaagaaagctgtat

SEQ ID NO: 3759 - DNA, 21 bp, Homo sapiens
aaaactcctccaggcagctga

SEQ ID NO: 3760 - DNA, 21 bp, Homo sapiens
ttctcgcacacgccattggca

SEQ ID NO: 3761 - DNA, 21 bp, Homo sapiens
ggaaaatggtaatctgagccc

SEQ ID NO: 3762 - DNA, 21 bp, Homo sapiens
tgaggtgggcgaaagagcacc

SEQ ID NO: 3763 - DNA, 21 bp, Homo sapiens
acattcaaccagccctgccca

SEQ ID NO: 3764 - DNA, 21 bp, Homo sapiens
gcagcaaaaatacttccccca

SEQ ID NO: 3765 - DNA, 21 bp, Homo sapiens
aggagtagtacaggtacgtat

SEQ ID NO: 3766 - DNA, 21 bp, Homo sapiens
gatcatattcttgtgaaagga

SEQ ID NO: 3767 - DNA, 21 bp, Homo sapiens
ggaatatctgggtaagtcatt

SEQ ID NO: 3768 - DNA, 21 bp, Homo sapiens
aaattccgagacgaagccacg

SEQ ID NO: 3769 - DNA, 21 bp, Homo sapiens
cagcgtgattctgattaaatg

SEQ ID NO: 3770 - DNA, 21 bp, Homo sapiens
gaatactattatcctaatttc

SEQ ID NO: 3771 - DNA, 21 bp, Homo sapiens
tccaggtgtcagggggcctca

SEQ ID NO: 3772 - DNA, 21 bp, Homo sapiens
ggccctgcgcccccctgtatg

SEQ ID NO: 3773 - DNA, 21 bp, Homo sapiens
caaagtcggggttctgggcaa

SEQ ID NO: 3774 - DNA, 21 bp, Homo sapiens
ctccactgggccacctccgag

SEQ ID NO: 3775 - DNA, 21 bp, Homo sapiens
atgaactcctgctggagccac

SEQ ID NO: 3776 - DNA, 21 bp, Homo sapiens
tgagacgtcctgcctgtatca

SEQ ID NO: 3777 - DNA, 21 bp, Homo sapiens
cttttgattacgacgagctgg

SEQ ID NO: 3778 - DNA, 21 bp, Homo sapiens
gaagcctgaactggtgagatg

SEQ ID NO: 3779 - DNA, 21 bp, Homo sapiens
tgaagcctgaactggtgagat

SEQ ID NO: 3780 - DNA, 21 bp, Homo sapiens
ctgggagacaggatgcttatg

SEQ ID NO: 3781 - DNA, 21 bp, Homo sapiens
tacagaggagcagaggaaaaa

SEQ ID NO: 3782 - DNA, 21 bp, Homo sapiens
tcccatttggtaagaccaaca

SEQ ID NO: 3783 - DNA, 21 bp, Homo sapiens
aatgggaagtgacctcgtttg

SEQ ID NO: 3784 - DNA, 21 bp, Homo sapiens
catttacgctgacatccctgt

SEQ ID NO: 3785 - DNA, 21 bp, Homo sapiens
tcacagcatgtgtaatctcct

SEQ ID NO: 3786 - DNA, 21 bp, Homo sapiens
gaaaaataaacgtaaaaaagc

SEQ ID NO: 3787 - DNA, 21 bp, Homo sapiens
gatggcttcccgcaacagact

SEQ ID NO: 3788 - DNA, 21 bp, Homo sapiens
caccagcctgcgcgcttccat

SEQ ID NO: 3789 - DNA, 21 bp, Homo sapiens
caggggagccctgttcacagg

SEQ ID NO: 3790 - DNA, 21 bp, Homo sapiens
aaagttcaaggcccccataga

SEQ ID NO: 3791 - DNA, 21 bp, Homo sapiens
gctccaaaccggaaacatcca

SEQ ID NO: 3792 - DNA, 21 bp, Homo sapiens
ggctgcagacgttgacgtcgg

SEQ ID NO: 3793 - DNA, 21 bp, Homo sapiens
acatcgctggtgcagatctgt

SEQ ID NO: 3794 - DNA, 21 bp, Homo sapiens
gacctcttacccttgtgtcca

SEQ ID NO: 3795 - DNA, 21 bp, Homo sapiens
aggcacctgtgtgggtgtcgg

SEQ ID NO: 3796 - DNA, 21 bp, Homo sapiens
gaggcacctgtgtgggtgtcg

SEQ ID NO: 3797 - DNA, 21 bp, Homo sapiens
catgcctgacctcgatctccg

SEQ ID NO: 3798 - DNA, 21 bp, Homo sapiens
caaagtctggtggtgggaaat

SEQ ID NO: 3799 - DNA, 21 bp, Homo sapiens
gatatctatgaccccttccac

SEQ ID NO: 3800 - DNA, 21 bp, Homo sapiens
gaaagtcagcgtcacagactt

SEQ ID NO: 3801 - DNA, 21 bp, Homo sapiens
ggaatggctagggaaaatcac

SEQ ID NO: 3802 - DNA, 21 bp, Homo sapiens
aatgcacccttgccgccttgg

SEQ ID NO: 3803 - DNA, 21 bp, Homo sapiens
ggcagccgggcctccctggcc

SEQ ID NO: 3804 - DNA, 21 bp, Homo sapiens
ccgtagctgccctggtaggtt

SEQ ID NO: 3805 - DNA, 21 bp, Homo sapiens
gggggagatgtaatagtgggg

SEQ ID NO: 3806 - DNA, 21 bp, Homo sapiens
gcccattcctcctgggtaaag

SEQ ID NO: 3807 - DNA, 21 bp, Homo sapiens
caagtaaaaccgaattatgcc

SEQ ID NO: 3808 - DNA, 21 bp, Homo sapiens
tgaccagcaatggtgttgctc

SEQ ID NO: 3809 - DNA, 21 bp, Homo sapiens
tctacccaaccaaatcctaaa

SEQ ID NO: 3810 - DNA, 21 bp, Homo sapiens
ctgggctcctccagcagaatc

SEQ ID NO: 3811 - DNA, 20 bp, Homo sapiens
ttttagtggcggcatgattt

SEQ ID NO: 3812 - DNA, 21 bp, Homo sapiens
tgtgctttccgcccagatcca

SEQ ID NO: 3813 - DNA, 21 bp, Homo sapiens
atccagctggtgtgggaggac

SEQ ID NO: 3814 - DNA, 21 bp, Homo sapiens
gaaaaggaggcgctcgggaac

SEQ ID NO: 3815 - DNA, 21 bp, Homo sapiens
tagtataaatgtcagggtaat

SEQ ID NO: 3816 - DNA, 21 bp, Homo sapiens
agttggtcaaccacgccaagg

SEQ ID NO: 3817 - DNA, 21 bp, Homo sapiens
agggaaccttgcatctcgaag

SEQ ID NO: 3818 - DNA, 21 bp, Homo sapiens
caaggccttcaatgaggtgat

SEQ ID NO: 3819 - DNA, 21 bp, Homo sapiens
tcctgatggccagtcgggatt

SEQ ID NO: 3820 - DNA, 21 bp, Homo sapiens
ggagtttcacaccccatggca

SEQ ID NO: 3821 - DNA, 21 bp, Homo sapiens
ccatacctttcttttatgcct

SEQ ID NO: 3822 - DNA, 22 bp, Homo sapiens
acaatgactctttgcggaaaac

SEQ ID NO: 3823 - DNA, 21 bp, Homo sapiens
agccgcagcttgtcccagcgc

SEQ ID NO: 3824 - DNA, 21 bp, Homo sapiens
tggtgcagttatatgcctgtg

SEQ ID NO: 3825 - DNA, 21 bp, Homo sapiens
tgtccccagacgagaatacaa

SEQ ID NO: 3826 - DNA, 21 bp, Homo sapiens
atttcaatgacgaggaggcca

SEQ ID NO: 3827 - DNA, 21 bp, Homo sapiens
cccctcagccgtggtggtgga

SEQ ID NO: 3828 - DNA, 21 bp, Homo sapiens
atgagcgggccgctggccgcg

SEQ ID NO: 3829 - DNA, 21 bp, Homo sapiens
ttggatggcttcctcctaacc

SEQ ID NO: 3830 - DNA, 21 bp, Homo sapiens
agcagcatgcggcctttgctg

SEQ ID NO: 3831 - DNA, 21 bp, Homo sapiens
ttctcaggagatctgggaacc

SEQ ID NO: 3832 - DNA, 21 bp, Homo sapiens
ggctggccacgttcactgtgt

SEQ ID NO: 3833 - DNA, 21 bp, Homo sapiens
tggatcttgccatcctctgaa

SEQ ID NO: 3834 - DNA, 21 bp, Homo sapiens
tcaacatgtacgccagcatct

SEQ ID NO: 3835 - DNA, 21 bp, Homo sapiens
tagcctaggcgcacaaagaag

SEQ ID NO: 3836 - DNA, 21 bp, Homo sapiens
ccctccttaagttaactaagg

SEQ ID NO: 3837 - DNA, 21 bp, Homo sapiens
ggcagcgccgcgtcccgggga

SEQ ID NO: 3838 - DNA, 21 bp, Homo sapiens
cagaatctgttttcagttgtg

SEQ ID NO: 3839 - DNA, 21 bp, Homo sapiens
cttcattatcatcttttcctt

SEQ ID NO: 3840 - DNA, 21 bp, Homo sapiens
catcgaggatgccaacctgat

SEQ ID NO: 3841 - DNA, 21 bp, Homo sapiens
ctcctcttctctttgagggtc

SEQ ID NO: 3842 - DNA, 21 bp, Homo sapiens
ctgagaagagcgtcggactca

SEQ ID NO: 3843 - DNA, 21 bp, Homo sapiens
gtcctggtcccgcagggcgaa

SEQ ID NO: 3844 - DNA, 21 bp, Homo sapiens
gcctggctcttcttggatttc

SEQ ID NO: 3845 - DNA, 21 bp, Homo sapiens
cctcatggccgctgtcacccc

SEQ ID NO: 3846 - DNA, 21 bp, Homo sapiens
ggggcccgagcggctctagtg

SEQ ID NO: 3847 - DNA, 21 bp, Homo sapiens
cgctcactgtcggctgctgaa

SEQ ID NO: 3848 - DNA, 21 bp, Homo sapiens
gaggctgcaacgctgaggtga

SEQ ID NO: 3849 - DNA, 21 bp, Homo sapiens
taccttgcttggtcacgtagg

SEQ ID NO: 3850 - DNA, 21 bp, Homo sapiens
tagggcctgcgtgaagttctg

SEQ ID NO: 3851 - DNA, 21 bp, Homo sapiens
accaaaccgcatgctagctcc

SEQ ID NO: 3852 - DNA, 21 bp, Homo sapiens
tttggcacagccagagcagct

SEQ ID NO: 3853 - DNA, 21 bp, Homo sapiens
caaccatccagtggaacagaa

SEQ ID NO: 3854 - DNA, 21 bp, Homo sapiens
gtttacaattgaaagcgtaaa

SEQ ID NO: 3855 - DNA, 21 bp, Homo sapiens
catgccaccaagcagaagtaa

SEQ ID NO: 3856 - DNA, 21 bp, Homo sapiens
aaggccttcagttgtggctca

SEQ ID NO: 3857 - DNA, 21 bp, Homo sapiens
ggggcagtgcgagggctggga

SEQ ID NO: 3858 - DNA, 21 bp, Homo sapiens
ctacgacgatgccctcttcct

SEQ ID NO: 3859 - DNA, 21 bp, Homo sapiens
cagctctgtggccatggatat

SEQ ID NO: 3860 - DNA, 21 bp, Homo sapiens
ttctctacagaaaagaaaagg

SEQ ID NO: 3861 - DNA, 21 bp, Homo sapiens
gattctggccgaggggactga

SEQ ID NO: 3862 - DNA, 21 bp, Homo sapiens
ggtctccaacccctccttact

SEQ ID NO: 3863 - DNA, 21 bp, Homo sapiens
gagtgccaggcagagcaggta

SEQ ID NO: 3864 - DNA, 21 bp, Homo sapiens
taagaatatgctggacacccg

SEQ ID NO: 3865 - DNA, 21 bp, Homo sapiens
atgcccacccggcccttcttt

SEQ ID NO: 3866 - DNA, 22 bp, Homo sapiens
caagaactgcttcccccagccg

SEQ ID NO: 3867 - DNA, 21 bp, Homo sapiens
atagccacccgtttccatgga

SEQ ID NO: 3868 - DNA, 21 bp, Homo sapiens
attggctgggagaagacggga

SEQ ID NO: 3869 - DNA, 21 bp, Homo sapiens
tggtttgtgcgttttcttcta

SEQ ID NO: 3870 - DNA, 21 bp, Homo sapiens
ccaaggaggccctagggctgg

SEQ ID NO: 3871 - DNA, 21 bp, Homo sapiens
catatgtcctgcccttaccct

SEQ ID NO: 3872 - DNA, 21 bp, Homo sapiens
accagctggggttcggggtgt

SEQ ID NO: 3873 - DNA, 21 bp, Homo sapiens
tttcccatacgcccgacaaga

SEQ ID NO: 3874 - DNA, 21 bp, Homo sapiens
catccagaaggcacagaaaga

SEQ ID NO: 3875 - DNA, 21 bp, Homo sapiens
gtgcattcttcttagaaattc

SEQ ID NO: 3876 - DNA, 21 bp, Homo sapiens
ctcatcccaggtgatccgcag

SEQ ID NO: 3877 - DNA, 21 bp, Homo sapiens
gtatccccgcggagagatgct

SEQ ID NO: 3878 - DNA, 23 bp, Homo sapiens
ctggaaggccgagcctgccacac

SEQ ID NO: 3879 - DNA, 21 bp, Homo sapiens
ttccaggtgcggcctggcttg

SEQ ID NO: 3880 - DNA, 21 bp, Homo sapiens
acctgtgagccgggcaccatg

SEQ ID NO: 3881 - DNA, 21 bp, Homo sapiens
tggaacgtgcgcctgcaggcc

SEQ ID NO: 3882 - DNA, 21 bp, Homo sapiens
ggccggcggcggccatagcgt

SEQ ID NO: 3883 - DNA, 23 bp, Homo sapiens
tcacagaatccttcttctggcta

SEQ ID NO: 3884 - DNA, 22 bp, Homo sapiens
ccaatagcacagctgccagtag

SEQ ID NO: 3885 - DNA, 21 bp, Homo sapiens
catccgactacgagaatttat

SEQ ID NO: 3886 - DNA, 21 bp, Homo sapiens
gttgtaagcaccctaaagtat

SEQ ID NO: 3887 - DNA, 21 bp, Homo sapiens
cccgctgggcgcggtccagga

SEQ ID NO: 3888 - DNA, 21 bp, Homo sapiens
gatcccggatgtggaaacctt

SEQ ID NO: 3889 - DNA, 21 bp, Homo sapiens
caggttgcggcgccaaggcag

SEQ ID NO: 3890 - DNA, 21 bp, Homo sapiens
atccctcctcgaacctgggcc

SEQ ID NO: 3891 - DNA, 21 bp, Homo sapiens
accatgtacagcatctgatat

SEQ ID NO: 3892 - DNA, 21 bp, Homo sapiens
gtacagcatctgatatccgag

SEQ ID NO: 3893 - DNA, 21 bp, Homo sapiens
tacagcatctgatatccgaga

SEQ ID NO: 3894 - DNA, 21 bp, Homo sapiens
tatatggctcgggcactcacc

SEQ ID NO: 3895 - DNA, 21 bp, Homo sapiens
ttctttctgcgcagccgcgaa

SEQ ID NO: 3896 - DNA, 21 bp, Homo sapiens
atggtcatcctggaagggaga

SEQ ID NO: 3897 - DNA, 21 bp, Homo sapiens
taccttgggccttgtcctgca

SEQ ID NO: 3898 - DNA, 20 bp, Homo sapiens
gagactggctggtttgataa

SEQ ID NO: 3899 - DNA, 21 bp, Homo sapiens
gtgctttgcccactatgatgt

SEQ ID NO: 3900 - DNA, 21 bp, Homo sapiens
tggcgtccagcgacatcaagg

SEQ ID NO: 3901 - DNA, 21 bp, Homo sapiens
tgctgaggaaaccacagccga

SEQ ID NO: 3902 - DNA, 21 bp, Homo sapiens
tgattgtgaacggcgtctgga

SEQ ID NO: 3903 - DNA, 21 bp, Homo sapiens
tcataatgcacggaatatagg

SEQ ID NO: 3904 - DNA, 21 bp, Homo sapiens
cttcagcatcgcctgagcaga

SEQ ID NO: 3905 - DNA, 21 bp, Homo sapiens
agttctgctacgcaggagggg

SEQ ID NO: 3906 - DNA, 21 bp, Homo sapiens
tcagtcaaggaagcgtatttc

SEQ ID NO: 3907 - DNA, 21 bp, Homo sapiens
ctatccaagatctcatcattc

SEQ ID NO: 3908 - DNA, 21 bp, Homo sapiens
ttctggggcggtagcaggagg

SEQ ID NO: 3909 - DNA, 21 bp, Homo sapiens
gggctcacccggaggaagggg

SEQ ID NO: 3910 - DNA, 21 bp, Homo sapiens
tgtgcactggccagcaaggta

SEQ ID NO: 3911 - DNA, 21 bp, Homo sapiens
ctatagggaacgagagcagcc

SEQ ID NO: 3912 - DNA, 21 bp, Homo sapiens
agctggtcacgtgccaaatct

SEQ ID NO: 3913 - DNA, 21 bp, Homo sapiens
ccttattgccgatccagggcc

SEQ ID NO: 3914 - DNA, 21 bp, Homo sapiens
tgaataccttcctttcaggag

SEQ ID NO: 3915 - DNA, 21 bp, Homo sapiens
cccgttctgcgggcgtgccag

SEQ ID NO: 3916 - DNA, 23 bp, Homo sapiens
gctgggcctcttacttcttacgg

SEQ ID NO: 3917 - DNA, 21 bp, Homo sapiens
tcactgaagttgggatactcg

SEQ ID NO: 3918 - DNA, 21 bp, Homo sapiens
atcacagaggcgcagcccggt

SEQ ID NO: 3919 - DNA, 21 bp, Homo sapiens
cacctccttcgtgcaaggtgt

SEQ ID NO: 3920 - DNA, 21 bp, Homo sapiens
tgttttagtcggaatgtggaa

SEQ ID NO: 3921 - DNA, 21 bp, Homo sapiens
ggttttggcaccatagatgat

SEQ ID NO: 3922 - DNA, 21 bp, Homo sapiens
accagctgtacgtacaaatgt

SEQ ID NO: 3923 - DNA, 21 bp, Homo sapiens
tgtggaccagcggtatctcag

SEQ ID NO: 3924 - DNA, 21 bp, Homo sapiens
aaaaaattccgcgaggcctgc

SEQ ID NO: 3925 - DNA, 21 bp, Homo sapiens
cgtagaagtcgaactaaatgt

SEQ ID NO: 3926 - DNA, 21 bp, Homo sapiens
aatcaaggtggccagtatgaa

SEQ ID NO: 3927 - DNA, 21 bp, Homo sapiens
agaattggagcgggctctctg

SEQ ID NO: 3928 - DNA, 21 bp, Homo sapiens
tgctgaattcgtcctcctggg

SEQ ID NO: 3929 - DNA, 21 bp, Homo sapiens
caggtactggatctcgggcgt

SEQ ID NO: 3930 - DNA, 21 bp, Homo sapiens
aagatgcgtggaaactaccta

SEQ ID NO: 3931 - DNA, 21 bp, Homo sapiens
gatgtattacggatatatacg

SEQ ID NO: 3932 - DNA, 21 bp, Homo sapiens
ctcgttcatagctggtgtgtg

SEQ ID NO: 3933 - DNA, 21 bp, Homo sapiens
cagccactaatgcaggtagtt

SEQ ID NO: 3934 - DNA, 21 bp, Homo sapiens
ggctcagaagtcatcatgcct

SEQ ID NO: 3935 - DNA, 21 bp, Homo sapiens
aagctgttgattagtttctat

SEQ ID NO: 3936 - DNA, 21 bp, Homo sapiens
caacttctccgagtagtatgt

SEQ ID NO: 3937 - DNA, 21 bp, Homo sapiens
tcctgggaaacgaccggctgg

SEQ ID NO: 3938 - DNA, 21 bp, Homo sapiens
ttttgaggccgtagcaaaata

SEQ ID NO: 3939 - DNA, 21 bp, Homo sapiens
tgcggcctgccgctgctgctc

SEQ ID NO: 3940 - DNA, 21 bp, Homo sapiens
atcaagaactcgctggaagtc

SEQ ID NO: 3941 - DNA, 21 bp, Homo sapiens
ctcaccttttactgataggtg

SEQ ID NO: 3942 - DNA, 21 bp, Homo sapiens
ggaagaactgggcccccagcc

SEQ ID NO: 3943 - DNA, 21 bp, Homo sapiens
agcagaaccagagccggaact

SEQ ID NO: 3944 - DNA, 21 bp, Homo sapiens
gtcgatgacctgagcaagttc

SEQ ID NO: 3945 - DNA, 21 bp, Homo sapiens
cgcctccaatgctatgagaat

SEQ ID NO: 3946 - DNA, 21 bp, Homo sapiens
agctggtagaccagatggggg

SEQ ID NO: 3947 - DNA, 21 bp, Homo sapiens
gggtccctttccagggcatct

SEQ ID NO: 3948 - DNA, 21 bp, Homo sapiens
aagtaagagacgggtactgga

SEQ ID NO: 3949 - DNA, 21 bp, Homo sapiens
agtggcagaaggtaagttcct

SEQ ID NO: 3950 - DNA, 21 bp, Homo sapiens
gtagctgaagcttttcccaca

SEQ ID NO: 3951 - DNA, 21 bp, Homo sapiens
gcttctaatggtcttcaacag

SEQ ID NO: 3952 - DNA, 21 bp, Homo sapiens
ttggcgaagcgccactgtgtc

SEQ ID NO: 3953 - DNA, 21 bp, Homo sapiens
gtttcttcaacgagaatttcc

SEQ ID NO: 3954 - DNA, 21 bp, Homo sapiens
accaaccagtggtctccagtg

SEQ ID NO: 3955 - DNA, 21 bp, Homo sapiens
aaggcttctcctacaaacagc

SEQ ID NO: 3956 - DNA, 21 bp, Homo sapiens
ggaacagcaggtccggctccg

SEQ ID NO: 3957 - DNA, 21 bp, Homo sapiens
agcgtcttcacggcggccgtc

SEQ ID NO: 3958 - DNA, 21 bp, Homo sapiens
gacccatccacgagtttttga

SEQ ID NO: 3959 - DNA, 21 bp, Homo sapiens
cttgtatgaccttctctccct

SEQ ID NO: 3960 - DNA, 21 bp, Homo sapiens
ctgtgttccgggcacacgtgt

SEQ ID NO: 3961 - DNA, 22 bp, Homo sapiens
ggtgatggccatcccagccata

SEQ ID NO: 3962 - DNA, 21 bp, Homo sapiens
agttgcagctgcctcccaagg

SEQ ID NO: 3963 - DNA, 21 bp, Homo sapiens
gtacttgacaccccagggagg

SEQ ID NO: 3964 - DNA, 21 bp, Homo sapiens
attgtgtttattggcaattct

SEQ ID NO: 3965 - DNA, 22 bp, Homo sapiens
gaagtggctgctgctctcagac

SEQ ID NO: 3966 - DNA, 22 bp, Homo sapiens
gtcggctgggcaggatgctggg

SEQ ID NO: 3967 - DNA, 21 bp, Homo sapiens
agaagggggacagagagggtg

SEQ ID NO: 3968 - DNA, 21 bp, Homo sapiens
ccagtaaacacgcttcgatat

SEQ ID NO: 3969 - DNA, 21 bp, Homo sapiens
ccagtcagaggggcagccatg

SEQ ID NO: 3970 - DNA, 21 bp, Homo sapiens
gggtactgagaatatgtttgt

SEQ ID NO: 3971 - DNA, 21 bp, Homo sapiens
caggtggttccgttttccagc

SEQ ID NO: 3972 - DNA, 21 bp, Homo sapiens
aaaaatcaccgattttgaaca

SEQ ID NO: 3973 - DNA, 21 bp, Homo sapiens
gcttggggttcgtggtttcac

SEQ ID NO: 3974 - DNA, 21 bp, Homo sapiens
gaagcagaggccaaggcacag

SEQ ID NO: 3975 - DNA, 21 bp, Homo sapiens
ttccccctttgtagaccactt

SEQ ID NO: 3976 - DNA, 21 bp, Homo sapiens
cggcagccctctcaggtaggc

SEQ ID NO: 3977 - DNA, 21 bp, Homo sapiens
ttattcacctcagccactggg

SEQ ID NO: 3978 - DNA, 21 bp, Homo sapiens
gacgtcatccgagaaggagct

SEQ ID NO: 3979 - DNA, 21 bp, Homo sapiens
cagctctggtatacatttcac

SEQ ID NO: 3980 - DNA, 21 bp, Homo sapiens
atcttccaaagacacatctac

SEQ ID NO: 3981 - DNA, 21 bp, Homo sapiens
gctgaatatacagaacaagat

SEQ ID NO: 3982 - DNA, 21 bp, Homo sapiens
cccctgctcaaatattcggtg

SEQ ID NO: 3983 - DNA, 23 bp, Homo sapiens
gctagaagctggaggagactcgc

SEQ ID NO: 3984 - DNA, 21 bp, Homo sapiens
ggattctatagcttcagacct

SEQ ID NO: 3985 - DNA, 21 bp, Homo sapiens
cgttttactgcgtctgtttca

SEQ ID NO: 3986 - DNA, 21 bp, Homo sapiens
gtactcaggtggagagaatgt

SEQ ID NO: 3987 - DNA, 21 bp, Homo sapiens
gtttgcaggagtgtcctgtat

SEQ ID NO: 3988 - DNA, 21 bp, Homo sapiens
tttatacaatcataattcctt

SEQ ID NO: 3989 - DNA, 21 bp, Homo sapiens
agctcacccgcggggcaccgg

SEQ ID NO: 3990 - DNA, 21 bp, Homo sapiens
agtagtgacgcgcataaggat

SEQ ID NO: 3991 - DNA, 21 bp, Homo sapiens
cggtggccgcggcggccgctc

SEQ ID NO: 3992 - DNA, 21 bp, Homo sapiens
aggacaacaaagacaaagctg

SEQ ID NO: 3993 - DNA, 23 bp, Homo sapiens
cttggcccactgtcccagccact

SEQ ID NO: 3994 - DNA, 21 bp, Homo sapiens
ctcatctttcgctgtgtattc

SEQ ID NO: 3995 - DNA, 21 bp, Homo sapiens
ttaatggtcatcaggacagtt

SEQ ID NO: 3996 - DNA, 23 bp, Homo sapiens
acccaggagccggctgccactgt

SEQ ID NO: 3997 - DNA, 20 bp, Homo sapiens
tactaatggcttccccacat

SEQ ID NO: 3998 - DNA, 21 bp, Homo sapiens
gaggctcaaatttttcagagg

SEQ ID NO: 3999 - DNA, 21 bp, Homo sapiens
gagcagcagtcgagagaacag

SEQ ID NO: 4000 - DNA, 21 bp, Homo sapiens
tgtgtccaacgttttcaacga

SEQ ID NO: 4001 - DNA, 21 bp, Homo sapiens
tcctccactcgaaacacctct

SEQ ID NO: 4002 - DNA, 21 bp, Homo sapiens
ggctgcagtgccagggtgggc

SEQ ID NO: 4003 - DNA, 21 bp, Homo sapiens
cactcacctccgcttatcatt

SEQ ID NO: 4004 - DNA, 21 bp, Homo sapiens
gctcaagtctacatggagctg

SEQ ID NO: 4005 - DNA, 21 bp, Homo sapiens
ctccggagggccgcgaggccc

SEQ ID NO: 4006 - DNA, 21 bp, Homo sapiens
tgatatggctcgtagagctgt

SEQ ID NO: 4007 - DNA, 21 bp, Homo sapiens
tgaggccatcgcacttaataa

SEQ ID NO: 4008 - DNA, 21 bp, Homo sapiens
tgtgttgatcctcttggttcg

SEQ ID NO: 4009 - DNA, 21 bp, Homo sapiens
tggtttccttttttgaattga

SEQ ID NO: 4010 - DNA, 22 bp, Homo sapiens
gaagtggctgctgagctgtcag

SEQ ID NO: 4011 - DNA, 20 bp, Homo sapiens
tcgagtggctaccttcacac

SEQ ID NO: 4012 - DNA, 21 bp, Homo sapiens
gtcgtcatgtggacaggactt

SEQ ID NO: 4013 - DNA, 21 bp, Homo sapiens
agagatcttcgtacttgcaac

SEQ ID NO: 4014 - DNA, 21 bp, Homo sapiens
tttgtacattctccctgcgtg

SEQ ID NO: 4015 - DNA, 21 bp, Homo sapiens
atgggctgtcggtagctggac

SEQ ID NO: 4016 - DNA, 21 bp, Homo sapiens
ggatggaaggcagggaaaaga

SEQ ID NO: 4017 - DNA, 21 bp, Homo sapiens
caacagaaacgagaagaacct

SEQ ID NO: 4018 - DNA, 21 bp, Homo sapiens
gataatgatgatatgacaggt

SEQ ID NO: 4019 - DNA, 21 bp, Homo sapiens
gcgtggggagtcccttttctg

SEQ ID NO: 4020 - DNA, 21 bp, Homo sapiens
cagcttctgtcggctggtcag

SEQ ID NO: 4021 - DNA, 21 bp, Homo sapiens
tgaacatcttctcatacactg

SEQ ID NO: 4022 - DNA, 21 bp, Homo sapiens
acagagtccctctcctgtttt

SEQ ID NO: 4023 - DNA, 21 bp, Homo sapiens
ggattcctttttgattaaaaa

SEQ ID NO: 4024 - DNA, 21 bp, Homo sapiens
tgttccattcagcatacagtg

SEQ ID NO: 4025 - DNA, 21 bp, Homo sapiens
agggctgtgtcaccatgccgg

SEQ ID NO: 4026 - DNA, 21 bp, Homo sapiens
cctttgaattccatcataagt

SEQ ID NO: 4027 - DNA, 21 bp, Homo sapiens
gagaaaggggcctcatcggaa

SEQ ID NO: 4028 - DNA, 21 bp, Homo sapiens
catagatggtcaatgcggcgt

SEQ ID NO: 4029 - DNA, 21 bp, Homo sapiens
tcatagatggtcaatgcggcg

SEQ ID NO: 4030 - DNA, 21 bp, Homo sapiens
tcaatgttgaaattgaaactc

SEQ ID NO: 4031 - DNA, 21 bp, Homo sapiens
gaggaggaggtgtctgctgct

SEQ ID NO: 4032 - DNA, 21 bp, Homo sapiens
tgcgcttcacggtcatggccc

SEQ ID NO: 4033 - DNA, 21 bp, Homo sapiens
tctgtgcgccggtctctccca

SEQ ID NO: 4034 - DNA, 21 bp, Homo sapiens
cactccaagaactgattgaaa

SEQ ID NO: 4035 - DNA, 21 bp, Homo sapiens
cggtccccctggcatggcagg

SEQ ID NO: 4036 - DNA, 21 bp, Homo sapiens
actacctatacggcaagatca

SEQ ID NO: 4037 - DNA, 21 bp, Homo sapiens
caagaaatatggataaacaga

SEQ ID NO: 4038 - DNA, 21 bp, Homo sapiens
cagctgggccgccagggtgcc

SEQ ID NO: 4039 - DNA, 21 bp, Homo sapiens
gtaccacagaggccagcatgg

SEQ ID NO: 4040 - DNA, 21 bp, Homo sapiens
catcctcgtcatggccctcag

SEQ ID NO: 4041 - DNA, 21 bp, Homo sapiens
ctccggaccaccctgctggcc

SEQ ID NO: 4042 - DNA, 21 bp, Homo sapiens
aatcctttcggctctctgggg

SEQ ID NO: 4043 - DNA, 21 bp, Homo sapiens
tccggaccaccctgctggccg

SEQ ID NO: 4044 - DNA, 21 bp, Homo sapiens
tacgctatatccagaatcggt

SEQ ID NO: 4045 - DNA, 21 bp, Homo sapiens
gtggggactgtggccgtactt

SEQ ID NO: 4046 - DNA, 21 bp, Homo sapiens
tggaaatgcagtggttcagat

SEQ ID NO: 4047 - DNA, 21 bp, Homo sapiens
ggaaatgcagtggttcagatt

SEQ ID NO: 4048 - DNA, 21 bp, Homo sapiens
ggaggcacctgtgtgggtgtc

SEQ ID NO: 4049 - DNA, 21 bp, Homo sapiens
ggatgttcccacagggaggag

SEQ ID NO: 4050 - DNA, 21 bp, Homo sapiens
cttcaaaatatgcagccaggt

SEQ ID NO: 4051 - DNA, 21 bp, Homo sapiens
tccctgcaccgggaaccagca

SEQ ID NO: 4052 - DNA, 21 bp, Homo sapiens
tgtgggtagcgacctatgaga

SEQ ID NO: 4053 - DNA, 21 bp, Homo sapiens
gggtctcggccgacagttctt

SEQ ID NO: 4054 - DNA, 21 bp, Homo sapiens
gttgcaatttcgcccctacgg

SEQ ID NO: 4055 - DNA, 21 bp, Homo sapiens
catccatagcgtccgtgggga

SEQ ID NO: 4056 - DNA, 21 bp, Homo sapiens
tggggccatcgctgagcctct

SEQ ID NO: 4057 - DNA, 21 bp, Homo sapiens
ggagaaagtggtcctttttca

SEQ ID NO: 4058 - DNA, 21 bp, Homo sapiens
ggacctgactcctttacagaa

SEQ ID NO: 4059 - DNA, 20 bp, Homo sapiens
acataccggcttgccaggag

SEQ ID NO: 4060 - DNA, 21 bp, Homo sapiens
cgaaccagagcctgcagggag

SEQ ID NO: 4061 - DNA, 21 bp, Homo sapiens
caatggaatcctcaatggcaa

SEQ ID NO: 4062 - DNA, 21 bp, Homo sapiens
gacttcacgccttgccaaaaa

SEQ ID NO: 4063 - DNA, 21 bp, Homo sapiens
ggggagatgtaatagtggggc

SEQ ID NO: 4064 - DNA, 21 bp, Homo sapiens
ctcaataatgttcaagataat

SEQ ID NO: 4065 - DNA, 21 bp, Homo sapiens
gggacacagcgttggacaatt

SEQ ID NO: 4066 - DNA, 21 bp, Homo sapiens
gagtaagttgttcaaactctg

SEQ ID NO: 4067 - DNA, 21 bp, Homo sapiens
tggtgtcttctagctcctaag

SEQ ID NO: 4068 - DNA, 21 bp, Homo sapiens
tacttacagaataacatctct

SEQ ID NO: 4069 - DNA, 21 bp, Homo sapiens
aggagtatttccagacaattt

SEQ ID NO: 4070 - DNA, 21 bp, Homo sapiens
ctgcttaccagccattttgac

SEQ ID NO: 4071 - DNA, 21 bp, Homo sapiens
taagaagtccggttcttggtc

SEQ ID NO: 4072 - DNA, 21 bp, Homo sapiens
gtgcactgagatgcccccact

SEQ ID NO: 4073 - DNA, 21 bp, Homo sapiens
gacccccctgcgtttctctct

SEQ ID NO: 4074 - DNA, 21 bp, Homo sapiens
atggcccaatggcctgacgct

SEQ ID NO: 4075 - DNA, 21 bp, Homo sapiens
ccttcggggtcagcttgaggc

SEQ ID NO: 4076 - DNA, 21 bp, Homo sapiens
ccatcgacaacgccaccacca

SEQ ID NO: 4077 - DNA, 21 bp, Homo sapiens
cgagcctggggaggggcctgt

SEQ ID NO: 4078 - DNA, 21 bp, Homo sapiens
tgggtataactgtgaggtgga

SEQ ID NO: 4079 - DNA, 21 bp, Homo sapiens
gccttgaccttggggttgccc

SEQ ID NO: 4080 - DNA, 21 bp, Homo sapiens
aattggatttcgaaaaaatta

SEQ ID NO: 4081 - DNA, 21 bp, Homo sapiens
actgggttccgaaagtgccac

SEQ ID NO: 4082 - DNA, 21 bp, Homo sapiens
gtattctctataggcatctct

SEQ ID NO: 4083 - DNA, 21 bp, Homo sapiens
ctcttggcccgctccacgctt

SEQ ID NO: 4084 - DNA, 22 bp, Homo sapiens
cgtgtagaggttttgatcacag

SEQ ID NO: 4085 - DNA, 21 bp, Homo sapiens
ctctgcccagggagtttgctg

SEQ ID NO: 4086 - DNA, 21 bp, Homo sapiens
gtggagtttcacaccccatgg

SEQ ID NO: 4087 - DNA, 21 bp, Homo sapiens
cttctgaactcacaataggtg

SEQ ID NO: 4088 - DNA, 23 bp, Homo sapiens
acactggcttgcctcctcctagc

SEQ ID NO: 4089 - DNA, 21 bp, Homo sapiens
ttttcttacctttatttcctt

SEQ ID NO: 4090 - DNA, 21 bp, Homo sapiens
tgcgcgtcccgggacgactgg

SEQ ID NO: 4091 - DNA, 21 bp, Homo sapiens
ttcttctccactaaccaattc

SEQ ID NO: 4092 - DNA, 21 bp, Homo sapiens
gtgtcccagatctggagggtt

SEQ ID NO: 4093 - DNA, 21 bp, Homo sapiens
tcaaagccagtatcaggcctt

SEQ ID NO: 4094 - DNA, 21 bp, Homo sapiens
aggtaacaacattgactcagg

SEQ ID NO: 4095 - DNA, 21 bp, Homo sapiens
agctgaaaagcgattgagaat

SEQ ID NO: 4096 - DNA, 21 bp, Homo sapiens
ttagtgttggcgtgtcttccc

SEQ ID NO: 4097 - DNA, 21 bp, Homo sapiens
tctcgaattcgcatccactta

SEQ ID NO: 4098 - DNA, 21 bp, Homo sapiens
ctaggatcatcgccaaaatca

SEQ ID NO: 4099 - DNA, 21 bp, Homo sapiens
cctcatggccgcaggggccgc

SEQ ID NO: 4100 - DNA, 21 bp, Homo sapiens
aggaagccccgcctgcccagc

SEQ ID NO: 4101 - DNA, 21 bp, Homo sapiens
gcagtgtggcctgatgtaatc

SEQ ID NO: 4102 - DNA, 21 bp, Homo sapiens
gaaagcgtctctagcagctga

SEQ ID NO: 4103 - DNA, 21 bp, Homo sapiens
tgggctgtcaggctccgagtc

SEQ ID NO: 4104 - DNA, 21 bp, Homo sapiens
agcaacagcaacagcagcagc

SEQ ID NO: 4105 - DNA, 21 bp, Homo sapiens
tgctcatgtcccagtacggcc

SEQ ID NO: 4106 - DNA, 21 bp, Homo sapiens
caaaagtcagggtgaccaggg

SEQ ID NO: 4107 - DNA, 21 bp, Homo sapiens
ggggtgggacgccatcagcct

SEQ ID NO: 4108 - DNA, 21 bp, Homo sapiens
agataggtagttggtagccat

SEQ ID NO: 4109 - DNA, 21 bp, Homo sapiens
gctgcaggggcggcatggaca

SEQ ID NO: 4110 - DNA, 21 bp, Homo sapiens
actcccagggtctggtcccag

SEQ ID NO: 4111 - DNA, 21 bp, Homo sapiens
agattcttcatccaggacatc

SEQ ID NO: 4112 - DNA, 21 bp, Homo sapiens
atgatgagaagggaacttctt

SEQ ID NO: 4113 - DNA, 21 bp, Homo sapiens
tggccagccgcgaccccaagc

SEQ ID NO: 4114 - DNA, 21 bp, Homo sapiens
ccagtcaaacctacctcttca

SEQ ID NO: 4115 - DNA, 21 bp, Homo sapiens
gcgttgcgctcgcccccacag

SEQ ID NO: 4116 - DNA, 21 bp, Homo sapiens
gattcgggtccggttgttcac

SEQ ID NO: 4117 - DNA, 21 bp, Homo sapiens
tgcgccccacgttctccagct

SEQ ID NO: 4118 - DNA, 21 bp, Homo sapiens
tggtgcagacgccatacaact

SEQ ID NO: 4119 - DNA, 21 bp, Homo sapiens
gaccgtgtaccgtcaggtggt

SEQ ID NO: 4120 - DNA, 21 bp, Homo sapiens
attttatacaccatgaggtga

SEQ ID NO: 4121 - DNA, 21 bp, Homo sapiens
ggtgcacagcgctcacaattt

SEQ ID NO: 4122 - DNA, 21 bp, Homo sapiens
ctgctggagacggaacggctg

SEQ ID NO: 4123 - DNA, 21 bp, Homo sapiens
agcaccgccagggccagcgcg

SEQ ID NO: 4124 - DNA, 21 bp, Homo sapiens
ggaacactctgccctggtgta

SEQ ID NO: 4125 - DNA, 22 bp, Homo sapiens
gtggcaggtgaagcagttttta

SEQ ID NO: 4126 - DNA, 21 bp, Homo sapiens
gttccctggacgggctgttcc

SEQ ID NO: 4127 - DNA, 21 bp, Homo sapiens
tgggggtcagtgatgcgggtg

SEQ ID NO: 4128 - DNA, 22 bp, Homo sapiens
aggagaagtcagccagccagtg

SEQ ID NO: 4129 - DNA, 23 bp, Homo sapiens
aacagtccactaaccctgccgat

SEQ ID NO: 4130 - DNA, 21 bp, Homo sapiens
acaatacatcgaccacgacat

SEQ ID NO: 4131 - DNA, 21 bp, Homo sapiens
gctgcacgcctgggccacgcg

SEQ ID NO: 4132 - DNA, 21 bp, Homo sapiens
caaccccgcatgcttcaggag

SEQ ID NO: 4133 - DNA, 21 bp, Homo sapiens
ccgtcggacttgtcacaattg

SEQ ID NO: 4134 - DNA, 21 bp, Homo sapiens
tgaggcatgcggggcagccag

SEQ ID NO: 4135 - DNA, 21 bp, Homo sapiens
attagacaaactcattagtat

SEQ ID NO: 4136 - DNA, 20 bp, Homo sapiens
aactatggcaggaaaatgca

SEQ ID NO: 4137 - DNA, 21 bp, Homo sapiens
ttccactggcgtggagctggc

SEQ ID NO: 4138 - DNA, 21 bp, Homo sapiens
tatatcaatacctcgggtaaa

SEQ ID NO: 4139 - DNA, 22 bp, Homo sapiens
tcaccggcggttggcgattcgg

SEQ ID NO: 4140 - DNA, 21 bp, Homo sapiens
ggccttcaccgacaggtcaaa

SEQ ID NO: 4141 - DNA, 23 bp, Homo sapiens
tctgtggcttgagtcctctcccc

SEQ ID NO: 4142 - DNA, 21 bp, Homo sapiens
cttacgtcttccagagcatga

SEQ ID NO: 4143 - DNA, 21 bp, Homo sapiens
tgcaagtgggcgccagaaaac

SEQ ID NO: 4144 - DNA, 21 bp, Homo sapiens
atggggatggcgctgcgaatc

SEQ ID NO: 4145 - DNA, 21 bp, Homo sapiens
atcatctcttctttagtactt

SEQ ID NO: 4146 - DNA, 21 bp, Homo sapiens
gccaccctggacgcactgttc

SEQ ID NO: 4147 - DNA, 21 bp, Homo sapiens
ttcagtgttatctgcaaacac

SEQ ID NO: 4148 - DNA, 21 bp, Homo sapiens
agtccagctcgtctagcgtct

SEQ ID NO: 4149 - DNA, 21 bp, Homo sapiens
actttactttcgagatggaaa

SEQ ID NO: 4150 - DNA, 21 bp, Homo sapiens
tgaggcaacaacatgaagctg

SEQ ID NO: 4151 - DNA, 21 bp, Homo sapiens
ggccggctgccgcctaggcgg

SEQ ID NO: 4152 - DNA, 21 bp, Homo sapiens
aggtcaccacgtttctgaaca

SEQ ID NO: 4153 - DNA, 21 bp, Homo sapiens
tagccataaacgggttgttcg

SEQ ID NO: 4154 - DNA, 22 bp, Homo sapiens
ggatcgaaactgtggtgaaaga

SEQ ID NO: 4155 - DNA, 21 bp, Homo sapiens
agttttgtcataattgtcatc

SEQ ID NO: 4156 - DNA, 21 bp, Homo sapiens
tgtttggctgcgtcgccaacg

SEQ ID NO: 4157 - DNA, 21 bp, Homo sapiens
agaggatccggggtgtctgga

SEQ ID NO: 4158 - DNA, 21 bp, Homo sapiens
aacttgtattcagcaggtacc

SEQ ID NO: 4159 - DNA, 21 bp, Homo sapiens
caggagctgcgggagcgagta

SEQ ID NO: 4160 - DNA, 21 bp, Homo sapiens
agctcgacgacgacgtcctcc

SEQ ID NO: 4161 - DNA, 21 bp, Homo sapiens
aacccgcaacgtacagaggaa

SEQ ID NO: 4162 - DNA, 21 bp, Homo sapiens
agcttttcaacgatcacatta

SEQ ID NO: 4163 - DNA, 21 bp, Homo sapiens
gttgtgtgacgtgatcctcat

SEQ ID NO: 4164 - DNA, 21 bp, Homo sapiens
ttcttcagcacgtatgacaga

SEQ ID NO: 4165 - DNA, 21 bp, Homo sapiens
cctccacagatcctgcaccct

SEQ ID NO: 4166 - DNA, 21 bp, Homo sapiens
atttccagttcttgatgaaca

SEQ ID NO: 4167 - DNA, 21 bp, Homo sapiens
gctctccagcgcctgtgccct

SEQ ID NO: 4168 - DNA, 20 bp, Homo sapiens
tcgagtggctggtggcctgg

SEQ ID NO: 4169 - DNA, 21 bp, Homo sapiens
cttggaaaaacgcctcaaggt

SEQ ID NO: 4170 - DNA, 21 bp, Homo sapiens
gctgggctgcgtggtggcctt

SEQ ID NO: 4171 - DNA, 21 bp, Homo sapiens
tctgcagtagcggaatgtctg

SEQ ID NO: 4172 - DNA, 21 bp, Homo sapiens
gagctcttgacgagtggccaa

SEQ ID NO: 4173 - DNA, 21 bp, Homo sapiens
tcctcgatgagcaggctgtcc

SEQ ID NO: 4174 - DNA, 21 bp, Homo sapiens
ggaagttttgaaaaagatcaa

SEQ ID NO: 4175 - DNA, 21 bp, Homo sapiens
gatggtgatgatgatgagggg

SEQ ID NO: 4176 - DNA, 21 bp, Homo sapiens
acacccttcggactgcagtca

SEQ ID NO: 4177 - DNA, 21 bp, Homo sapiens
tcacgtgaccgacatcagagt

SEQ ID NO: 4178 - DNA, 21 bp, Homo sapiens
ctcaaggccaagaacatcaag

SEQ ID NO: 4179 - DNA, 21 bp, Homo sapiens
ctgctcagtggcacctggcga

SEQ ID NO: 4180 - DNA, 21 bp, Homo sapiens
tcagaaatttggatgaaaact

SEQ ID NO: 4181 - DNA, 21 bp, Homo sapiens
ttcctacctttaatgcatcgt

SEQ ID NO: 4182 - DNA, 23 bp, Homo sapiens
attaaaattacctcctcttccac

SEQ ID NO: 4183 - DNA, 21 bp, Homo sapiens
ggtgacagatcacggctcgtg

SEQ ID NO: 4184 - DNA, 21 bp, Homo sapiens
ccagtaaatgactctgaaccc

SEQ ID NO: 4185 - DNA, 21 bp, Homo sapiens
tgggatagccacatcagagct

SEQ ID NO: 4186 - DNA, 21 bp, Homo sapiens
tccaactccaggaggctgagc

SEQ ID NO: 4187 - DNA, 21 bp, Homo sapiens
aattctatagccacaagtcca

SEQ ID NO: 4188 - DNA, 21 bp, Homo sapiens
ctggggcctacgggccatcaa

SEQ ID NO: 4189 - DNA, 21 bp, Homo sapiens
gccaaaaaatggcctctcaga

SEQ ID NO: 4190 - DNA, 21 bp, Homo sapiens
tccttaaacacgaaccacagg

SEQ ID NO: 4191 - DNA, 21 bp, Homo sapiens
acgcgccgcccggtgttggcg

SEQ ID NO: 4192 - DNA, 21 bp, Homo sapiens
tgccgccttacgacacagccc

SEQ ID NO: 4193 - DNA, 21 bp, Homo sapiens
acacctgaggcggctcctctt

SEQ ID NO: 4194 - DNA, 21 bp, Homo sapiens
cgacaggtacgtcaccatctt

SEQ ID NO: 4195 - DNA, 21 bp, Homo sapiens
cggtaacaaacgggagtgtga

SEQ ID NO: 4196 - DNA, 21 bp, Homo sapiens
tcctcctggctacccctgagc

SEQ ID NO: 4197 - DNA, 21 bp, Homo sapiens
tatgatgcttgttgtgcagat

SEQ ID NO: 4198 - DNA, 21 bp, Homo sapiens
ttctctgagacgctggccatg

SEQ ID NO: 4199 - DNA, 21 bp, Homo sapiens
tttatgggtcgtaacttccaa

SEQ ID NO: 4200 - DNA, 21 bp, Homo sapiens
cccagtttttgtcatcctggc

SEQ ID NO: 4201 - DNA, 20 bp, Homo sapiens
ggacattggcttggaggctg

SEQ ID NO: 4202 - DNA, 21 bp, Homo sapiens
gccacatagcggtcataggcc

SEQ ID NO: 4203 - DNA, 21 bp, Homo sapiens
gcgctggtgcgcgtggtggtg

SEQ ID NO: 4204 - DNA, 21 bp, Homo sapiens
agctgagcaacgatctgatga

SEQ ID NO: 4205 - DNA, 21 bp, Homo sapiens
gacgtctcccgggaggacttt

SEQ ID NO: 4206 - DNA, 20 bp, Homo sapiens
ttctatggcaggaaaagctg

SEQ ID NO: 4207 - DNA, 21 bp, Homo sapiens
ggtctgacagcgcaatatcct

SEQ ID NO: 4208 - DNA, 21 bp, Homo sapiens
agttggatatgagaggcgtgg

SEQ ID NO: 4209 - DNA, 21 bp, Homo sapiens
gccgatgcccaggaagaaaac

SEQ ID NO: 4210 - DNA, 21 bp, Homo sapiens
tttttaggaatgtgaaagtta

SEQ ID NO: 4211 - DNA, 22 bp, Homo sapiens
gagcaatggcggctgccagtat

SEQ ID NO: 4212 - DNA, 21 bp, Homo sapiens
cccaccacgcgtccacccagg

SEQ ID NO: 4213 - DNA, 21 bp, Homo sapiens
gtgaataccacgctttatgag

SEQ ID NO: 4214 - DNA, 21 bp, Homo sapiens
tggtttcaggggagatgtgtg

SEQ ID NO: 4215 - DNA, 21 bp, Homo sapiens
acatgcagggcttccagcttc

SEQ ID NO: 4216 - DNA, 21 bp, Homo sapiens
ccgagtcacgcttcgcaagct

SEQ ID NO: 4217 - DNA, 22 bp, Homo sapiens
cggccgcgctcacagtgtcacg

SEQ ID NO: 4218 - DNA, 23 bp, Homo sapiens
gaggccacccagctgacccgcca

SEQ ID NO: 4219 - DNA, 21 bp, Homo sapiens
cgttgaatttgtatcaaactc

SEQ ID NO: 4220 - DNA, 21 bp, Homo sapiens
tgcggatgctgcggtaaacca

SEQ ID NO: 4221 - DNA, 21 bp, Homo sapiens
agagtttccacgaaaacgcaa

SEQ ID NO: 4222 - DNA, 21 bp, Homo sapiens
atgccctcctcacgtttgtct

SEQ ID NO: 4223 - DNA, 21 bp, Homo sapiens
tacagattttcgatactttat

SEQ ID NO: 4224 - DNA, 21 bp, Homo sapiens
tttcagtcacctgcaggtgat

SEQ ID NO: 4225 - DNA, 21 bp, Homo sapiens
ccagggcggacgcccacttgt

SEQ ID NO: 4226 - DNA, 21 bp, Homo sapiens
ctccattgaccagcctcaact

SEQ ID NO: 4227 - DNA, 21 bp, Homo sapiens
taagcggtaacgtctataagc

SEQ ID NO: 4228 - DNA, 21 bp, Homo sapiens
caggtcagccgccctgtgatg

SEQ ID NO: 4229 - DNA, 21 bp, Homo sapiens
acgggcctcagtagccaggaa

SEQ ID NO: 4230 - DNA, 21 bp, Homo sapiens
gaagaaagcagatgaacctga

SEQ ID NO: 4231 - DNA, 21 bp, Homo sapiens
cggattctggtgattcccgcc

SEQ ID NO: 4232 - DNA, 21 bp, Homo sapiens
ggacttcaaccgggagaagtt

SEQ ID NO: 4233 - DNA, 21 bp, Homo sapiens
accttgatcttcaataagttc

SEQ ID NO: 4234 - DNA, 22 bp, Homo sapiens
tggagtggctggcttaggggca

SEQ ID NO: 4235 - DNA, 21 bp, Homo sapiens
ctacattcccgaaaacaaccc

SEQ ID NO: 4236 - DNA, 21 bp, Homo sapiens
cgccccacccggcctgataaa

SEQ ID NO: 4237 - DNA, 21 bp, Homo sapiens
ttacctgtttctccacagggc

SEQ ID NO: 4238 - DNA, 21 bp, Homo sapiens
ctgccgccggcgggctgggct

SEQ ID NO: 4239 - DNA, 22 bp, Homo sapiens
ggagcggcggctggagaagcag

SEQ ID NO: 4240 - DNA, 21 bp, Homo sapiens
tgtggctgtcgtggctgctct

SEQ ID NO: 4241 - DNA, 21 bp, Homo sapiens
gggtggtaacgtctcaggtga

SEQ ID NO: 4242 - DNA, 21 bp, Homo sapiens
atcttgggcacgaacttgccc

SEQ ID NO: 4243 - DNA, 21 bp, Homo sapiens
cctcctccacctattagcaat

SEQ ID NO: 4244 - DNA, 21 bp, Homo sapiens
acttatgagacgccaggtatg

SEQ ID NO: 4245 - DNA, 21 bp, Homo sapiens
ggaagtgcaagcccagctctg

SEQ ID NO: 4246 - DNA, 21 bp, Homo sapiens
ctccattggacgagagtaatt

SEQ ID NO: 4247 - DNA, 21 bp, Homo sapiens
agcgagggtcctcttggcccc

SEQ ID NO: 4248 - DNA, 21 bp, Homo sapiens
gtttttcaaaatccagagagt

SEQ ID NO: 4249 - DNA, 21 bp, Homo sapiens
ctcaaggaaacgtgtgaagta

SEQ ID NO: 4250 - DNA, 21 bp, Homo sapiens
aatcacctgtcgccaagccgg

SEQ ID NO: 4251 - DNA, 21 bp, Homo sapiens
gaaaagtactgagaggcaggg

SEQ ID NO: 4252 - DNA, 21 bp, Homo sapiens
acccttggaaaaaaatcgatt

SEQ ID NO: 4253 - DNA, 21 bp, Homo sapiens
tgcccctggcccagctgtaag

SEQ ID NO: 4254 - DNA, 21 bp, Homo sapiens
ctgtacgtgcgcatctgccag

SEQ ID NO: 4255 - DNA, 21 bp, Homo sapiens
acatgatgtaccaggccatgg

SEQ ID NO: 4256 - DNA, 22 bp, Homo sapiens
agtgagcggagcaagccactct

SEQ ID NO: 4257 - DNA, 21 bp, Homo sapiens
agctttttcctgcaattctcc

SEQ ID NO: 4258 - DNA, 23 bp, Homo sapiens
gcaaatactccatcaattttctc

SEQ ID NO: 4259 - DNA, 21 bp, Homo sapiens
cataaagaagcaatcaagcca

SEQ ID NO: 4260 - DNA, 21 bp, Homo sapiens
cttattcacagagcccagtaa

SEQ ID NO: 4261 - DNA, 21 bp, Homo sapiens
tgctcctgctgggccaaagcc

SEQ ID NO: 4262 - DNA, 21 bp, Homo sapiens
cttcagctccgacataagggc

SEQ ID NO: 4263 - DNA, 21 bp, Homo sapiens
tgccgcatcacgggaatgaag

SEQ ID NO: 4264 - DNA, 21 bp, Homo sapiens
gcagtgccacccacgatttga

SEQ ID NO: 4265 - DNA, 21 bp, Homo sapiens
atgtgtcctcggaatgtatct

SEQ ID NO: 4266 - DNA, 21 bp, Homo sapiens
actggctgcgcgtgggctccg

SEQ ID NO: 4267 - DNA, 21 bp, Homo sapiens
gctcttgcccggtgacctcac

SEQ ID NO: 4268 - DNA, 21 bp, Homo sapiens
gatgggcctgcggccaaacct

SEQ ID NO: 4269 - DNA, 21 bp, Homo sapiens
ttgggactcctccagaaggta

SEQ ID NO: 4270 - DNA, 21 bp, Homo sapiens
gttacaacctgactaatgaac

SEQ ID NO: 4271 - DNA, 21 bp, Homo sapiens
gaccgaagggcagaagcgcta

SEQ ID NO: 4272 - DNA, 21 bp, Homo sapiens
gcattccagggacacccactt

SEQ ID NO: 4273 - DNA, 21 bp, Homo sapiens
ggcaagggccggagggccaaa

SEQ ID NO: 4274 - DNA, 21 bp, Homo sapiens
ggtaatgttggatgtaaatca

SEQ ID NO: 4275 - DNA, 21 bp, Homo sapiens
cacttcaagcatctcctactc

SEQ ID NO: 4276 - DNA, 21 bp, Homo sapiens
ccgcgctggcgtagacgatca

SEQ ID NO: 4277 - DNA, 21 bp, Homo sapiens
tcaccatcccgcggcccttct

SEQ ID NO: 4278 - DNA, 21 bp, Homo sapiens
ggctcttgagcgggccaaaag

SEQ ID NO: 4279 - DNA, 21 bp, Homo sapiens
atgaggcggacgctccgcgcc

SEQ ID NO: 4280 - DNA, 21 bp, Homo sapiens
cccagaagggcggactggccg

SEQ ID NO: 4281 - DNA, 23 bp, Homo sapiens
gacaggctggtgcggttcaggta

SEQ ID NO: 4282 - DNA, 21 bp, Homo sapiens
agagcactgacgggaaacaag

SEQ ID NO: 4283 - DNA, 21 bp, Homo sapiens
gagggctcagcgctcccgatg

SEQ ID NO: 4284 - DNA, 21 bp, Homo sapiens
gcttcttctactatacaagat

SEQ ID NO: 4285 - DNA, 21 bp, Homo sapiens
taatttgcatgagttagacct

SEQ ID NO: 4286 - DNA, 20 bp, Homo sapiens
ctggagtggtgggtgcccgc

SEQ ID NO: 4287 - DNA, 21 bp, Homo sapiens
atgggcctccggttcatgccg

SEQ ID NO: 4288 - DNA, 21 bp, Homo sapiens
tggcagcgtcgcggaccaagg

SEQ ID NO: 4289 - DNA, 21 bp, Homo sapiens
tccggctgttcggacggaata

SEQ ID NO: 4290 - DNA, 21 bp, Homo sapiens
gtaaaaaatgaaaaaaaaagc

SEQ ID NO: 4291 - DNA, 21 bp, Homo sapiens
catcgccatgggtaagaaacc

SEQ ID NO: 4292 - DNA, 21 bp, Homo sapiens
caggaaagggggaaataacaa

SEQ ID NO: 4293 - DNA, 21 bp, Homo sapiens
tgagattggcgtggttatagt

SEQ ID NO: 4294 - DNA, 21 bp, Homo sapiens
agcagatgccatcatgactct

SEQ ID NO: 4295 - DNA, 21 bp, Homo sapiens
cagagggtctgcccatcgtcg

SEQ ID NO: 4296 - DNA, 23 bp, Homo sapiens
ttcttctccctctccagccactg

SEQ ID NO: 4297 - DNA, 21 bp, Homo sapiens
gtgaagagagactgctccatg

SEQ ID NO: 4298 - DNA, 21 bp, Homo sapiens
ttccgatttcttgatgacatg

SEQ ID NO: 4299 - DNA, 21 bp, Homo sapiens
gacattatgacaatgtttgaa

SEQ ID NO: 4300 - DNA, 22 bp, Homo sapiens
gaatgaagccagcagccacatc

SEQ ID NO: 4301 - DNA, 21 bp, Homo sapiens
agtccctcactatccactggc

SEQ ID NO: 4302 - DNA, 21 bp, Homo sapiens
agaaccccacgcaggaggtgg

SEQ ID NO: 4303 - DNA, 20 bp, Homo sapiens
cgttgtggcaggtgccctgg

SEQ ID NO: 4304 - DNA, 21 bp, Homo sapiens
tccaagaatgcggtcatggtc

SEQ ID NO: 4305 - DNA, 21 bp, Homo sapiens
tttggaaagcggcaatgcttt

SEQ ID NO: 4306 - DNA, 21 bp, Homo sapiens
gcttgtagcacggtgagacct

SEQ ID NO: 4307 - DNA, 20 bp, Homo sapiens
atcagtggcaggaagggcca

SEQ ID NO: 4308 - DNA, 20 bp, Homo sapiens
gtttgtggctgccttcaaca

SEQ ID NO: 4309 - DNA, 21 bp, Homo sapiens
gcactggggcaggccatcgat

SEQ ID NO: 4310 - DNA, 23 bp, Homo sapiens
ccactggcttgcgtagggtgcca

SEQ ID NO: 4311 - DNA, 22 bp, Homo sapiens
agctcatctgccgagccaatgg

SEQ ID NO: 4312 - DNA, 21 bp, Homo sapiens
tgctggactacggcctggacc

SEQ ID NO: 4313 - DNA, 23 bp, Homo sapiens
cagcggcgggaacgatagctgca

SEQ ID NO: 4314 - DNA, 21 bp, Homo sapiens
caccatcccacgccatgccac

SEQ ID NO: 4315 - DNA, 21 bp, Homo sapiens
agaatggggagctgatcatgg

SEQ ID NO: 4316 - DNA, 21 bp, Homo sapiens
ggtacgggagatcgtactgct

SEQ ID NO: 4317 - DNA, 21 bp, Homo sapiens
cgccacctggggcactgtcca

SEQ ID NO: 4318 - DNA, 21 bp, Homo sapiens
cgggcggcctcacttgccctt

SEQ ID NO: 4319 - DNA, 21 bp, Homo sapiens
atttgaggcaagtggcattca

SEQ ID NO: 4320 - DNA, 22 bp, Homo sapiens
tctgtggctgctgtggtcagac

SEQ ID NO: 4321 - DNA, 21 bp, Homo sapiens
ggtgactgatgtacgtggaag

SEQ ID NO: 4322 - DNA, 21 bp, Homo sapiens
tggtggagcacgtggaggcag

SEQ ID NO: 4323 - DNA, 21 bp, Homo sapiens
agtagcagtaccttccagagc

SEQ ID NO: 4324 - DNA, 21 bp, Homo sapiens
ggctggtcccgtggggccaaa

SEQ ID NO: 4325 - DNA, 21 bp, Homo sapiens
tcaccgcagccgactcctgca

SEQ ID NO: 4326 - DNA, 21 bp, Homo sapiens
atactgtcggagatgtacata

SEQ ID NO: 4327 - DNA, 21 bp, Homo sapiens
ctctcagagtcttctgaatgt

SEQ ID NO: 4328 - DNA, 21 bp, Homo sapiens
atttaggactcttgctgagat

SEQ ID NO: 4329 - DNA, 21 bp, Homo sapiens
acacagaaggccaaaaggaag

SEQ ID NO: 4330 - DNA, 21 bp, Homo sapiens
ccggtgcagatcgaaggggag

SEQ ID NO: 4331 - DNA, 21 bp, Homo sapiens
gaccagggacgtggctgtgga

SEQ ID NO: 4332 - DNA, 21 bp, Homo sapiens
tagctgtcccgctcttccttc

SEQ ID NO: 4333 - DNA, 21 bp, Homo sapiens
atgtgaacatgaatagagaca

SEQ ID NO: 4334 - DNA, 21 bp, Homo sapiens
caggcatctcggaaatcccta

SEQ ID NO: 4335 - DNA, 21 bp, Homo sapiens
ggtccagatcggcaccagcat

SEQ ID NO: 4336 - DNA, 21 bp, Homo sapiens
gacatgggcccccggctgggc

SEQ ID NO: 4337 - DNA, 21 bp, Homo sapiens
tatatggcatcgaaagtgtta

SEQ ID NO: 4338 - DNA, 21 bp, Homo sapiens
ttggaccctcggaggtagaga

SEQ ID NO: 4339 - DNA, 21 bp, Homo sapiens
cagatagggcctaactctttc

SEQ ID NO: 4340 - DNA, 21 bp, Homo sapiens
aggtgcggccgccaggccatt

SEQ ID NO: 4341 - DNA, 21 bp, Homo sapiens
gaatgctccacttcttccatt

SEQ ID NO: 4342 - DNA, 21 bp, Homo sapiens
ggcagggggagaagctttctc

SEQ ID NO: 4343 - DNA, 21 bp, Homo sapiens
ggcgtggggagtcccttttct

SEQ ID NO: 4344 - DNA, 21 bp, Homo sapiens
cggcgtggggagtcccttttc

SEQ ID NO: 4345 - DNA, 21 bp, Homo sapiens
tctacggcatggtgcacgtct

SEQ ID NO: 4346 - DNA, 23 bp, Homo sapiens
agatctggtctagcagccacttc

SEQ ID NO: 4347 - DNA, 21 bp, Homo sapiens
ggatcatattcttgtgaaagg

SEQ ID NO: 4348 - DNA, 21 bp, Homo sapiens
ttttaggtcaaccaggaaggt

SEQ ID NO: 4349 - DNA, 21 bp, Homo sapiens
acagcgtgattctgattaaat

SEQ ID NO: 4350 - DNA, 21 bp, Homo sapiens
gctttcttcatctgactgatc

SEQ ID NO: 4351 - DNA, 21 bp, Homo sapiens
gccctgcgcccccctgtatga

SEQ ID NO: 4352 - DNA, 21 bp, Homo sapiens
ggcgatgcactgtcgaggccc

SEQ ID NO: 4353 - DNA, 21 bp, Homo sapiens
gagcttggaacgagatcttct

SEQ ID NO: 4354 - DNA, 21 bp, Homo sapiens
tataggaacctggtctccctg

SEQ ID NO: 4355 - DNA, 22 bp, Homo sapiens
tcaaagcttttatgtcatcttg

SEQ ID NO: 4356 - DNA, 21 bp, Homo sapiens
ccttctcactggagttcctgg

SEQ ID NO: 4357 - DNA, 21 bp, Homo sapiens
attaggtttgatggacctcat

SEQ ID NO: 4358 - DNA, 21 bp, Homo sapiens
ccatttggtaagaccaacatt

SEQ ID NO: 4359 - DNA, 21 bp, Homo sapiens
cccatttggtaagaccaacat

SEQ ID NO: 4360 - DNA, 21 bp, Homo sapiens
tataatgtgtttgagcaaacc

SEQ ID NO: 4361 - DNA, 21 bp, Homo sapiens
acaggacccttccacgggctg

SEQ ID NO: 4362 - DNA, 21 bp, Homo sapiens
tgtcgtcatcgtggagcgtgg

SEQ ID NO: 4363 - DNA, 21 bp, Homo sapiens
tccatcagaggggcttgtggg

SEQ ID NO: 4364 - DNA, 21 bp, Homo sapiens
cacacttctcctgctcccctt

SEQ ID NO: 4365 - DNA, 21 bp, Homo sapiens
tgttttgagcgtatagtgtcc

SEQ ID NO: 4366 - DNA, 21 bp, Homo sapiens
cacagcatgtgtaatctccta

SEQ ID NO: 4367 - DNA, 21 bp, Homo sapiens
gtggaccacaatacccgcacc

SEQ ID NO: 4368 - DNA, 21 bp, Homo sapiens
ctgacttttgggggccagact

SEQ ID NO: 4369 - DNA, 21 bp, Homo sapiens
gtgggtggctccatccctgtc

SEQ ID NO: 4370 - DNA, 21 bp, Homo sapiens
aggtgaagcgccagcggggtg

SEQ ID NO: 4371 - DNA, 21 bp, Homo sapiens
acttggttccgtatcgatccc

SEQ ID NO: 4372 - DNA, 21 bp, Homo sapiens
gcagagggccggaaaaaggcc

SEQ ID NO: 4373 - DNA, 21 bp, Homo sapiens
gagacccaaacgtgcatctgc

SEQ ID NO: 4374 - DNA, 21 bp, Homo sapiens
gcgggttctgcgttcatctta

SEQ ID NO: 4375 - DNA, 21 bp, Homo sapiens
ttttccaagacgcagcatgtg

SEQ ID NO: 4376 - DNA, 21 bp, Homo sapiens
cttgatggcacgaactggaac

SEQ ID NO: 4377 - DNA, 21 bp, Homo sapiens
ctcgtccagcggaacctgtgg

SEQ ID NO: 4378 - DNA, 21 bp, Homo sapiens
aatcaatttaggtgagttcaa

SEQ ID NO: 4379 - DNA, 21 bp, Homo sapiens
ctcacagtgatcgcctgcata

SEQ ID NO: 4380 - DNA, 21 bp, Homo sapiens
tcatcctcgtcatggccctca

SEQ ID NO: 4381 - DNA, 21 bp, Homo sapiens
agccacaagcttgtcttgaac

SEQ ID NO: 4382 - DNA, 21 bp, Homo sapiens
aagcagtccagccccaacctg

SEQ ID NO: 4383 - DNA, 21 bp, Homo sapiens
aggagcaccaagtgttgctgc

SEQ ID NO: 4384 - DNA, 21 bp, Homo sapiens
gaaaccggatgctgagtaccc

SEQ ID NO: 4385 - DNA, 21 bp, Homo sapiens
tgaaaccggatgctgagtacc

SEQ ID NO: 4386 - DNA, 21 bp, Homo sapiens
tcatcgggataagaagctgaa

SEQ ID NO: 4387 - DNA, 21 bp, Homo sapiens
atgaattgcacgaggacagtg

SEQ ID NO: 4388 - DNA, 21 bp, Homo sapiens
agccactccccaaggcctgca

SEQ ID NO: 4389 - DNA, 21 bp, Homo sapiens
gcccggttccgcctggccatg

SEQ ID NO: 4390 - DNA, 21 bp, Homo sapiens
ccagccagcccagaagctgcc

SEQ ID NO: 4391 - DNA, 21 bp, Homo sapiens
tggcaaaaccgccggtgagat

SEQ ID NO: 4392 - DNA, 21 bp, Homo sapiens
cggtgaattctgtctcccact

SEQ ID NO: 4393 - DNA, 21 bp, Homo sapiens
actttatccagtatccaaata

SEQ ID NO: 4394 - DNA, 21 bp, Homo sapiens
atgaccagcaatggtgttgct

SEQ ID NO: 4395 - DNA, 21 bp, Homo sapiens
ggccagatctccaactatgtg

SEQ ID NO: 4396 - DNA, 21 bp, Homo sapiens
catcaagagtaagttgttcaa

SEQ ID NO: 4397 - DNA, 21 bp, Homo sapiens
aatattattacggtatagttt

SEQ ID NO: 4398 - DNA, 21 bp, Homo sapiens
ggcaggcatggctgttgcagg

SEQ ID NO: 4399 - DNA, 21 bp, Homo sapiens
gtgttatgtatagtaatggat

SEQ ID NO: 4400 - DNA, 21 bp, Homo sapiens
tcggcctccacgctctggcgc

SEQ ID NO: 4401 - DNA, 21 bp, Homo sapiens
ctgcaggatcttggcgtagga

SEQ ID NO: 4402 - DNA, 21 bp, Homo sapiens
tgcttaccagccattttgacc

SEQ ID NO: 4403 - DNA, 21 bp, Homo sapiens
aagacagtttatccaatggag

SEQ ID NO: 4404 - DNA, 21 bp, Homo sapiens
ttcccatccttccttaaggcc

SEQ ID NO: 4405 - DNA, 21 bp, Homo sapiens
atagggaatcccttctactta

SEQ ID NO: 4406 - DNA, 21 bp, Homo sapiens
cattggcccccacgggccctg

SEQ ID NO: 4407 - DNA, 21 bp, Homo sapiens
cggcaacgccaggtgggtggt

SEQ ID NO: 4408 - DNA, 21 bp, Homo sapiens
tggtacaagccggaaggaaac

SEQ ID NO: 4409 - DNA, 21 bp, Homo sapiens
ccacaggagcaaaagtggaag

SEQ ID NO: 4410 - DNA, 21 bp, Homo sapiens
acaaggccttcaatgaggtga

SEQ ID NO: 4411 - DNA, 21 bp, Homo sapiens
attctttgctggaaagatact

SEQ ID NO: 4412 - DNA, 21 bp, Homo sapiens
gtagccagacgaacacagttg

SEQ ID NO: 4413 - DNA, 23 bp, Homo sapiens
aagtgattctgaagaagaagaaa

SEQ ID NO: 4414 - DNA, 21 bp, Homo sapiens
gctggcatggcctcgggtagg

SEQ ID NO: 4415 - DNA, 21 bp, Homo sapiens
aatgtcaatccgacctgagct

SEQ ID NO: 4416 - DNA, 21 bp, Homo sapiens
atatgacaaggatggaagagg

SEQ ID NO: 4417 - DNA, 21 bp, Homo sapiens
gtaaatgcctgaaatgctggg

SEQ ID NO: 4418 - DNA, 21 bp, Homo sapiens
tgttcttgtgacaactttgaa

SEQ ID NO: 4419 - DNA, 21 bp, Homo sapiens
attagatactgtgctgacttc

SEQ ID NO: 4420 - DNA, 21 bp, Homo sapiens
gcctggaggaccagtgagaat

SEQ ID NO: 4421 - DNA, 21 bp, Homo sapiens
gtttcttccgtctccatggcc

SEQ ID NO: 4422 - DNA, 21 bp, Homo sapiens
cctgtgaagacgcctgttctg

SEQ ID NO: 4423 - DNA, 21 bp, Homo sapiens
gccaacctgcgctgtgccctt

SEQ ID NO: 4424 - DNA, 21 bp, Homo sapiens
aagtcagtgacatttaaatgt

SEQ ID NO: 4425 - DNA, 21 bp, Homo sapiens
ccacgcagacgcggcccacgc

SEQ ID NO: 4426 - DNA, 21 bp, Homo sapiens
ttcacacggacgccctggtat

SEQ ID NO: 4427 - DNA, 21 bp, Homo sapiens
ctgccctgtccgcagggaact

SEQ ID NO: 4428 - DNA, 21 bp, Homo sapiens
tgcggggaccggcactgctcc

SEQ ID NO: 4429 - DNA, 21 bp, Homo sapiens
cacatacccagtgctagagag

SEQ ID NO: 4430 - DNA, 21 bp, Homo sapiens
aagtatatgccggagacatct

SEQ ID NO: 4431 - DNA, 21 bp, Homo sapiens
ttgggccagcgccagaactct

SEQ ID NO: 4432 - DNA, 21 bp, Homo sapiens
gaggaattctctgcatgatga

SEQ ID NO: 4433 - DNA, 21 bp, Homo sapiens
atgaccttaccgcagtgacct

SEQ ID NO: 4434 - DNA, 21 bp, Homo sapiens
tcctcacagccgttccaacaa

SEQ ID NO: 4435 - DNA, 21 bp, Homo sapiens
tctctgtcttgatgggcgaga

SEQ ID NO: 4436 - DNA, 21 bp, Homo sapiens
cgtagtttcgtcattattctt

SEQ ID NO: 4437 - DNA, 21 bp, Homo sapiens
tggcatgactaccccatggtt

SEQ ID NO: 4438 - DNA, 21 bp, Homo sapiens
accgccttgaagatgctccta

SEQ ID NO: 4439 - DNA, 21 bp, Homo sapiens
taatggattgagattccacac

SEQ ID NO: 4440 - DNA, 20 bp, Homo sapiens
tgttactggcttggatgttg

SEQ ID NO: 4441 - DNA, 21 bp, Homo sapiens
gcccctgcagacttcatcgtg

SEQ ID NO: 4442 - DNA, 21 bp, Homo sapiens
tcgtggccttcgggcacggcc

SEQ ID NO: 4443 - DNA, 20 bp, Homo sapiens
tgttgtggcaggaatggtga

SEQ ID NO: 4444 - DNA, 21 bp, Homo sapiens
agtggccatcgccagccggtt

SEQ ID NO: 4445 - DNA, 21 bp, Homo sapiens
atgtcataaaggtgaggacag

SEQ ID NO: 4446 - DNA, 21 bp, Homo sapiens
agaagaaagatcttgccattc

SEQ ID NO: 4447 - DNA, 22 bp, Homo sapiens
actcttcgccgcggcccagccg

SEQ ID NO: 4448 - DNA, 21 bp, Homo sapiens
ggacaccaaggtcatcagcat

SEQ ID NO: 4449 - DNA, 21 bp, Homo sapiens
cactggcactcgttggcactg

SEQ ID NO: 4450 - DNA, 21 bp, Homo sapiens
accagcgtggcggcggacttc

SEQ ID NO: 4451 - DNA, 21 bp, Homo sapiens
tacattagaccggtcacaaca

SEQ ID NO: 4452 - DNA, 21 bp, Homo sapiens
ctagccctgccgctgggccca

SEQ ID NO: 4453 - DNA, 21 bp, Homo sapiens
agttttatttcttcttctctt

SEQ ID NO: 4454 - DNA, 21 bp, Homo sapiens
cccagggtgaagaagagaaag

SEQ ID NO: 4455 - DNA, 21 bp, Homo sapiens
ggaccacagtctgcaaagaca

SEQ ID NO: 4456 - DNA, 21 bp, Homo sapiens
ccagacgtctggaggaagtac

SEQ ID NO: 4457 - DNA, 21 bp, Homo sapiens
gtgggaaagcgtttctccaga

SEQ ID NO: 4458 - DNA, 21 bp, Homo sapiens
ttccatccatcgggtcaatgc

SEQ ID NO: 4459 - DNA, 21 bp, Homo sapiens
tcacctgtggcgaagacaaca

SEQ ID NO: 4460 - DNA, 21 bp, Homo sapiens
ccagatataacgctgtataag

SEQ ID NO: 4461 - DNA, 22 bp, Homo sapiens
taagttgtgcatcaccagccac

SEQ ID NO: 4462 - DNA, 21 bp, Homo sapiens
cttcttggagccggtctgagt

SEQ ID NO: 4463 - DNA, 21 bp, Homo sapiens
aaaaaaatgtaaatgacatca

SEQ ID NO: 4464 - DNA, 22 bp, Homo sapiens
tttatggctaccacttcacgag

SEQ ID NO: 4465 - DNA, 21 bp, Homo sapiens
actcctactacggcctgatgc

SEQ ID NO: 4466 - DNA, 21 bp, Homo sapiens
aagaagctcccgctgtggcag

SEQ ID NO: 4467 - DNA, 21 bp, Homo sapiens
aaatgtagacatgtcatatcc

SEQ ID NO: 4468 - DNA, 21 bp, Homo sapiens
caggcctggcgcatggccagc

SEQ ID NO: 4469 - DNA, 21 bp, Homo sapiens
gaggcggcctgcgagtcagcc

SEQ ID NO: 4470 - DNA, 21 bp, Homo sapiens
taccagaggtgagggacactg

SEQ ID NO: 4471 - DNA, 21 bp, Homo sapiens
gacccacggccgccgtgggag

SEQ ID NO: 4472 - DNA, 21 bp, Homo sapiens
ggcttttgcacgtctaaagag

SEQ ID NO: 4473 - DNA, 21 bp, Homo sapiens
gtctaaaaaacgaacaatatc

SEQ ID NO: 4474 - DNA, 21 bp, Homo sapiens
aagcccatcacgttatcctgt

SEQ ID NO: 4475 - DNA, 21 bp, Homo sapiens
tgacccgtccgtaataattta

SEQ ID NO: 4476 - DNA, 21 bp, Homo sapiens
catagctttacgagcctggct

SEQ ID NO: 4477 - DNA, 21 bp, Homo sapiens
cctggctaccagtccaaacac

SEQ ID NO: 4478 - DNA, 21 bp, Homo sapiens
ggcatcggccgcacaggcacc

SEQ ID NO: 4479 - DNA, 21 bp, Homo sapiens
gcacgactccgtcaccgcctg

SEQ ID NO: 4480 - DNA, 21 bp, Homo sapiens
ctgtccaaagtggtatcaaca

SEQ ID NO: 4481 - DNA, 21 bp, Homo sapiens
aggtgaagtggccagtacacc

SEQ ID NO: 4482 - DNA, 21 bp, Homo sapiens
agtgcccggcgggcaggtggg

SEQ ID NO: 4483 - DNA, 21 bp, Homo sapiens
ggaacggctttgaccagtgcg

SEQ ID NO: 4484 - DNA, 21 bp, Homo sapiens
ccacgcccgaccttcccaggg

SEQ ID NO: 4485 - DNA, 21 bp, Homo sapiens
ggtgggacgccggagaccctt

SEQ ID NO: 4486 - DNA, 21 bp, Homo sapiens
ttgatcaggagctggggcacg

SEQ ID NO: 4487 - DNA, 21 bp, Homo sapiens
ctgaccaggcctggtagagga

SEQ ID NO: 4488 - DNA, 21 bp, Homo sapiens
ataagcatgacgacctatgat

SEQ ID NO: 4489 - DNA, 21 bp, Homo sapiens
aagctgaacggcagccacctg

SEQ ID NO: 4490 - DNA, 21 bp, Homo sapiens
ggccatggcgcggacgcgggt

SEQ ID NO: 4491 - DNA, 20 bp, Homo sapiens
ctatcccaagcctgccacta

SEQ ID NO: 4492 - DNA, 21 bp, Homo sapiens
cctccttcagcgccacctgtc

SEQ ID NO: 4493 - DNA, 21 bp, Homo sapiens
agtcttccccgtccatgtccc

SEQ ID NO: 4494 - DNA, 21 bp, Homo sapiens
gcaccagcacgtgcacacgat

SEQ ID NO: 4495 - DNA, 21 bp, Homo sapiens
ggatagtcaccgaatgcagag

SEQ ID NO: 4496 - DNA, 21 bp, Homo sapiens
taccagaatccggattataat

SEQ ID NO: 4497 - DNA, 21 bp, Homo sapiens
tgtggctggcgtggagaccct

SEQ ID NO: 4498 - DNA, 21 bp, Homo sapiens
ctatgaggggcgcgtcatcca

SEQ ID NO: 4499 - DNA, 21 bp, Homo sapiens
taaggagagaggattctggaa

SEQ ID NO: 4500 - DNA, 21 bp, Homo sapiens
aaagtttaaggaagtccattt

SEQ ID NO: 4501 - DNA, 21 bp, Homo sapiens
ccagtgcatccgctctatctg

SEQ ID NO: 4502 - DNA, 21 bp, Homo sapiens
acaactcatccgctcttaaaa

SEQ ID NO: 4503 - DNA, 21 bp, Homo sapiens
acctgcaggtggaagtgatga

SEQ ID NO: 4504 - DNA, 21 bp, Homo sapiens
ctaaaactgcaaagtccagga

SEQ ID NO: 4505 - DNA, 21 bp, Homo sapiens
ccacctcgccggtggcattcc

SEQ ID NO: 4506 - DNA, 21 bp, Homo sapiens
caaacacagacgttttaggag

SEQ ID NO: 4507 - DNA, 21 bp, Homo sapiens
agaccatgataaatcaaaagg

SEQ ID NO: 4508 - DNA, 21 bp, Homo sapiens
gatgcccgtcgtgtagataat

SEQ ID NO: 4509 - DNA, 21 bp, Homo sapiens
ctcagcagggcgttcttgtag

SEQ ID NO: 4510 - DNA, 21 bp, Homo sapiens
aacttactgttttttctttcc

SEQ ID NO: 4511 - DNA, 21 bp, Homo sapiens
ccctggcgccgcagccgcctt

SEQ ID NO: 4512 - DNA, 22 bp, Homo sapiens
gcggcaggcgtcgtacaccatg

SEQ ID NO: 4513 - DNA, 21 bp, Homo sapiens
ctacatttaccctattgattt

SEQ ID NO: 4514 - DNA, 21 bp, Homo sapiens
cacggggagcgctacatggca

SEQ ID NO: 4515 - DNA, 21 bp, Homo sapiens
cgcatcctggcggccatcttg

SEQ ID NO: 4516 - DNA, 21 bp, Homo sapiens
tggcactaccccaggaacaga

SEQ ID NO: 4517 - DNA, 21 bp, Homo sapiens
gttacctttcccacggccagg

SEQ ID NO: 4518 - DNA, 21 bp, Homo sapiens
tcagaaacaaggatggcgtgt

SEQ ID NO: 4519 - DNA, 21 bp, Homo sapiens
gcaggctactgtgtggcaacc

SEQ ID NO: 4520 - DNA, 20 bp, Homo sapiens
tgttgtggatggtttgccat

SEQ ID NO: 4521 - DNA, 21 bp, Homo sapiens
acagtgagaccggcaaaccag

SEQ ID NO: 4522 - DNA, 21 bp, Homo sapiens
gtcgtggaggggaagtccaaa

SEQ ID NO: 4523 - DNA, 21 bp, Homo sapiens
ctccccacacgttgcaagtga

SEQ ID NO: 4524 - DNA, 21 bp, Homo sapiens
ggatcggggccgaggcagggc

SEQ ID NO: 4525 - DNA, 21 bp, Homo sapiens
cccacatggccgccgcttcct

SEQ ID NO: 4526 - DNA, 21 bp, Homo sapiens
catataagggcaaggaagttc

SEQ ID NO: 4527 - DNA, 21 bp, Homo sapiens
aattcttcccctggaatgaac

SEQ ID NO: 4528 - DNA, 21 bp, Homo sapiens
catttttcaacgtgctgcgcc

SEQ ID NO: 4529 - DNA, 21 bp, Homo sapiens
gtcctctgtcgttgcacaaat

SEQ ID NO: 4530 - DNA, 21 bp, Homo sapiens
agcccctaccccagagtgaag

SEQ ID NO: 4531 - DNA, 21 bp, Homo sapiens
tagacctccgtacagctgtca

SEQ ID NO: 4532 - DNA, 21 bp, Homo sapiens
acgcaggttcggccatcgcgg

SEQ ID NO: 4533 - DNA, 21 bp, Homo sapiens
ctgacctggcgcgctgccatg

SEQ ID NO: 4534 - DNA, 20 bp, Homo sapiens
ttggtgtggcttgggcacct

SEQ ID NO: 4535 - DNA, 20 bp, Homo sapiens
agacatggctgggcagctgc

SEQ ID NO: 4536 - DNA, 21 bp, Homo sapiens
ccgatttgacgtttctgaaat

SEQ ID NO: 4537 - DNA, 21 bp, Homo sapiens
tctgaagcccgtttaggcata

SEQ ID NO: 4538 - DNA, 22 bp, Homo sapiens
gcagcggcggcagccgcaggct

SEQ ID NO: 4539 - DNA, 21 bp, Homo sapiens
agcaagaaacccttcagtttt

SEQ ID NO: 4540 - DNA, 21 bp, Homo sapiens
cgtcgtcgtcggccatggtcc

SEQ ID NO: 4541 - DNA, 21 bp, Homo sapiens
aatcggtcctcgcacctcacc

SEQ ID NO: 4542 - DNA, 21 bp, Homo sapiens
ttgtgaggccccctggccatc

SEQ ID NO: 4543 - DNA, 21 bp, Homo sapiens
cactggggttcgaccacacct

SEQ ID NO: 4544 - DNA, 20 bp, Homo sapiens
tgctgtggctggtccacatg

SEQ ID NO: 4545 - DNA, 21 bp, Homo sapiens
acttaaaatctactgcagtgc

SEQ ID NO: 4546 - DNA, 21 bp, Homo sapiens
aagcaggttcggttacctgcc

SEQ ID NO: 4547 - DNA, 21 bp, Homo sapiens
tttgaccagacggattatttt

SEQ ID NO: 4548 - DNA, 21 bp, Homo sapiens
ttttggaggcaagaattttgt

SEQ ID NO: 4549 - DNA, 21 bp, Homo sapiens
ttgagcagacgtgtgatacag

SEQ ID NO: 4550 - DNA, 21 bp, Homo sapiens
attttgtaaatctaatagcat

SEQ ID NO: 4551 - DNA, 21 bp, Homo sapiens
tcttatactcgtgtgctcttt

SEQ ID NO: 4552 - DNA, 21 bp, Homo sapiens
cttttccagacgacccgcctc

SEQ ID NO: 4553 - DNA, 21 bp, Homo sapiens
catggagcaaggggtgagtgc

SEQ ID NO: 4554 - DNA, 21 bp, Homo sapiens
cttatatcctcatgtcctgct

SEQ ID NO: 4555 - DNA, 21 bp, Homo sapiens
agcccgaccagagaaatctgt

SEQ ID NO: 4556 - DNA, 23 bp, Homo sapiens
ggtatggcggtttgtttactctg

SEQ ID NO: 4557 - DNA, 21 bp, Homo sapiens
gtaaatctgtgggggttttgc

SEQ ID NO: 4558 - DNA, 22 bp, Homo sapiens
gaagaggcggccgccttctccc

SEQ ID NO: 4559 - DNA, 20 bp, Homo sapiens
ctttatggctaccacttcac

SEQ ID NO: 4560 - DNA, 21 bp, Homo sapiens
ggggtctggagtgcccagagc

SEQ ID NO: 4561 - DNA, 21 bp, Homo sapiens
cgcccatttggagccaagaca

SEQ ID NO: 4562 - DNA, 21 bp, Homo sapiens
ggagcatcaggtagcgtctca

SEQ ID NO: 4563 - DNA, 21 bp, Homo sapiens
gggattccgtcccctcacaga

SEQ ID NO: 4564 - DNA, 21 bp, Homo sapiens
gacgcaaggcgtagcccagct

SEQ ID NO: 4565 - DNA, 21 bp, Homo sapiens
acagactgcccgtggagcagg

SEQ ID NO: 4566 - DNA, 21 bp, Homo sapiens
gcaggtggtagaggtggatga

SEQ ID NO: 4567 - DNA, 21 bp, Homo sapiens
tccctctctcgtaacccttcc

SEQ ID NO: 4568 - DNA, 21 bp, Homo sapiens
ccctgacggccgaccagatgg

SEQ ID NO: 4569 - DNA, 21 bp, Homo sapiens
caggtctgtgcggctgctaaa

SEQ ID NO: 4570 - DNA, 21 bp, Homo sapiens
gggccgggctcagttcagctg

SEQ ID NO: 4571 - DNA, 21 bp, Homo sapiens
agtatatggccggaaaggctt

SEQ ID NO: 4572 - DNA, 21 bp, Homo sapiens
gccagtaatccacaggtgtta

SEQ ID NO: 4573 - DNA, 21 bp, Homo sapiens
tcattctgaacaatcctattt

SEQ ID NO: 4574 - DNA, 21 bp, Homo sapiens
cctgcacacagatctcatcac

SEQ ID NO: 4575 - DNA, 21 bp, Homo sapiens
ggggcagaaatgttttcttgg

SEQ ID NO: 4576 - DNA, 21 bp, Homo sapiens
gtttttccactattacctctg

SEQ ID NO: 4577 - DNA, 21 bp, Homo sapiens
ctcggccaccgccacgctgca

SEQ ID NO: 4578 - DNA, 21 bp, Homo sapiens
agacagaggcggcagaaggta

SEQ ID NO: 4579 - DNA, 23 bp, Homo sapiens
gcctagacacatacctgccaatc

SEQ ID NO: 4580 - DNA, 21 bp, Homo sapiens
ttctggcactccatgaaggcc

SEQ ID NO: 4581 - DNA, 21 bp, Homo sapiens
cagtggagaagacctgctgtg

SEQ ID NO: 4582 - DNA, 23 bp, Homo sapiens
ggcgcggcgcccacatctcccgc

SEQ ID NO: 4583 - DNA, 22 bp, Homo sapiens
caaggcctgcggctgccactga

SEQ ID NO: 4584 - DNA, 23 bp, Homo sapiens
aacggccagcaggcccagcccct

SEQ ID NO: 4585 - DNA, 23 bp, Homo sapiens
gcatggctggtgaggtcacagcg

SEQ ID NO: 4586 - DNA, 22 bp, Homo sapiens
gcagcggcggcagccgcaggct

SEQ ID NO: 4587 - DNA, 21 bp, Homo sapiens
tcacttggtacgagataatga

SEQ ID NO: 4588 - DNA, 23 bp, Homo sapiens
ttgtcctacctttccagccatat

SEQ ID NO: 4589 - DNA, 21 bp, Homo sapiens
gggttggcacatcgccaataa

SEQ ID NO: 4590 - DNA, 21 bp, Homo sapiens
atgaactccacgacgatggat

SEQ ID NO: 4591 - DNA, 21 bp, Homo sapiens
aacattcccacaagccactcc

SEQ ID NO: 4592 - DNA, 21 bp, Homo sapiens
atgaagcatatgggaaagcaa

SEQ ID NO: 4593 - DNA, 21 bp, Homo sapiens
aggaggaggacgcctgcactt

SEQ ID NO: 4594 - DNA, 21 bp, Homo sapiens
aggtgctggacgtcagtcagg

SEQ ID NO: 4595 - DNA, 21 bp, Homo sapiens
ctcgggatccggtgatgaagt

SEQ ID NO: 4596 - DNA, 21 bp, Homo sapiens
tttggtggcattatctgcatt

SEQ ID NO: 4597 - DNA, 21 bp, Homo sapiens
gccttggactcgtagtacacc

SEQ ID NO: 4598 - DNA, 21 bp, Homo sapiens
tcaaattcctccatgatgagc

SEQ ID NO: 4599 - DNA, 21 bp, Homo sapiens
aaaaggcaacagatgaggcaa

SEQ ID NO: 4600 - DNA, 21 bp, Homo sapiens
tacctttcacgcagacatgtg

SEQ ID NO: 4601 - DNA, 21 bp, Homo sapiens
tttggagcccggatccctccc

SEQ ID NO: 4602 - DNA, 21 bp, Homo sapiens
cactacctccaaggtgatttt

SEQ ID NO: 4603 - DNA, 21 bp, Homo sapiens
cagctaatgaggcctctcaac

SEQ ID NO: 4604 - DNA, 21 bp, Homo sapiens
aacagggctgcatgcctcctc

SEQ ID NO: 4605 - DNA, 21 bp, Homo sapiens
aagatactcacggaggagatt

SEQ ID NO: 4606 - DNA, 21 bp, Homo sapiens
gtttgcatttgcaaactcaca

SEQ ID NO: 4607 - DNA, 21 bp, Homo sapiens
agtgaccactccccggcaggg

SEQ ID NO: 4608 - DNA, 21 bp, Homo sapiens
acggctccgcgccctgcaccg

SEQ ID NO: 4609 - DNA, 22 bp, Homo sapiens
gctagacttaccaagccacagt

SEQ ID NO: 4610 - DNA, 21 bp, Homo sapiens
ttgcagattgccttgcaattt

SEQ ID NO: 4611 - DNA, 21 bp, Homo sapiens
acctggctgtcgtccatgctg

SEQ ID NO: 4612 - DNA, 21 bp, Homo sapiens
atgcaaacccgtcaaccagcc

SEQ ID NO: 4613 - DNA, 22 bp, Homo sapiens
gccaacccccgacctgccaata

SEQ ID NO: 4614 - DNA, 21 bp, Homo sapiens
agctgtgcccgagtcgaggac

SEQ ID NO: 4615 - DNA, 21 bp, Homo sapiens
aggttctctacgaccttttgt

SEQ ID NO: 4616 - DNA, 21 bp, Homo sapiens
caccagcatcgtcaaaaaact

SEQ ID NO: 4617 - DNA, 21 bp, Homo sapiens
cgcagagggcgaggatgaagg

SEQ ID NO: 4618 - DNA, 21 bp, Homo sapiens
atgtcagcacggtgctcctgt

SEQ ID NO: 4619 - DNA, 21 bp, Homo sapiens
tcccaaccaacgtccaggtgg

SEQ ID NO: 4620 - DNA, 21 bp, Homo sapiens
acctgtctgcggggtaaccca

SEQ ID NO: 4621 - DNA, 21 bp, Homo sapiens
tccatcaggacgggctggagc

SEQ ID NO: 4622 - DNA, 21 bp, Homo sapiens
tgtaccggcagctccttacct

SEQ ID NO: 4623 - DNA, 21 bp, Homo sapiens
tgggtgagccgggagagcctg

SEQ ID NO: 4624 - DNA, 21 bp, Homo sapiens
ttatgaaattcgaccagggaa

SEQ ID NO: 4625 - DNA, 21 bp, Homo sapiens
agggcttcgggggcatcatgt

SEQ ID NO: 4626 - DNA, 21 bp, Homo sapiens
ctccgactaccaaagctgcca

SEQ ID NO: 4627 - DNA, 21 bp, Homo sapiens
gtcaggagcttcagaataggc

SEQ ID NO: 4628 - DNA, 21 bp, Homo sapiens
gcctgggcccgagccttgacc

SEQ ID NO: 4629 - DNA, 21 bp, Homo sapiens
cgtggcctggagactggccag

SEQ ID NO: 4630 - DNA, 21 bp, Homo sapiens
catgggtatcccgtagtaggc

SEQ ID NO: 4631 - DNA, 21 bp, Homo sapiens
tactctgcaaaccacagttct

SEQ ID NO: 4632 - DNA, 21 bp, Homo sapiens
ttctgttcttgaaggagagaa

SEQ ID NO: 4633 - DNA, 21 bp, Homo sapiens
agttggtgggaggatcagcta

SEQ ID NO: 4634 - DNA, 21 bp, Homo sapiens
ctgtgctgaacggtagggtcc

SEQ ID NO: 4635 - DNA, 21 bp, Homo sapiens
cattgacacacgacgcaatac

SEQ ID NO: 4636 - DNA, 21 bp, Homo sapiens
atgagcaggtcgaaggggatg

SEQ ID NO: 4637 - DNA, 21 bp, Homo sapiens
acgctctccggtgagtctgta

SEQ ID NO: 4638 - DNA, 21 bp, Homo sapiens
cagttgtgcaagtaacagtaa

SEQ ID NO: 4639 - DNA, 21 bp, Homo sapiens
ctaaagctgcgtcgcagaggc

SEQ ID NO: 4640 - DNA, 21 bp, Homo sapiens
ggtgccatgatgttggtgcca

SEQ ID NO: 4641 - DNA, 21 bp, Homo sapiens
tcttccagtgcgcccccgaga

SEQ ID NO: 4642 - DNA, 21 bp, Homo sapiens
aacactcacccgcatgccgac

SEQ ID NO: 4643 - DNA, 21 bp, Homo sapiens
gttcagctgtgatgcctcgca

SEQ ID NO: 4644 - DNA, 21 bp, Homo sapiens
agatgaagaggctgtcatcat

SEQ ID NO: 4645 - DNA, 23 bp, Homo sapiens
gcggggtggcgggcaccagccac

SEQ ID NO: 4646 - DNA, 23 bp, Homo sapiens
tccctgcagctggccagccgatg

SEQ ID NO: 4647 - DNA, 22 bp, Homo sapiens
tctgtggctgctgtggtcagac

SEQ ID NO: 4648 - DNA, 21 bp, Homo sapiens
aaagagattctgcatggttct

SEQ ID NO: 4649 - DNA, 21 bp, Homo sapiens
cctgtagttgccggcgtgctg

SEQ ID NO: 4650 - DNA, 21 bp, Homo sapiens
cagcgccaggcggatgtaaag

SEQ ID NO: 4651 - DNA, 21 bp, Homo sapiens
aacccagttcgagcattaagt

SEQ ID NO: 4652 - DNA, 21 bp, Homo sapiens
agcagccgcagttcactgagt

SEQ ID NO: 4653 - DNA, 21 bp, Homo sapiens
gggcgagcaggctgctctttc

SEQ ID NO: 4654 - DNA, 21 bp, Homo sapiens
tgatatggctcgtagagctgt

SEQ ID NO: 4655 - DNA, 21 bp, Homo sapiens
agagattgtcgtctgactggt

SEQ ID NO: 4656 - DNA, 23 bp, Homo sapiens
tgatccagtcattccagccgatg

SEQ ID NO: 4657 - DNA, 21 bp, Homo sapiens
ttgcctctcccgctcctggcg

SEQ ID NO: 4658 - DNA, 21 bp, Homo sapiens
cttggtgaacgatgggtgtct

SEQ ID NO: 4659 - DNA, 21 bp, Homo sapiens
aaccaggtgacgcggtagcag

SEQ ID NO: 4660 - DNA, 21 bp, Homo sapiens
cctgcacatcgtgctctgcct

SEQ ID NO: 4661 - DNA, 21 bp, Homo sapiens
tatcatgaatcgaagagtctg

SEQ ID NO: 4662 - DNA, 21 bp, Homo sapiens
ggagaccacatggttctagga

SEQ ID NO: 4663 - DNA, 21 bp, Homo sapiens
gcgtccttcacgtcttcgtga

SEQ ID NO: 4664 - DNA, 21 bp, Homo sapiens
aaggatgaacggagaggaaga

SEQ ID NO: 4665 - DNA, 21 bp, Homo sapiens
gcacgtgtttcgaatcccact

SEQ ID NO: 4666 - DNA, 21 bp, Homo sapiens
ctccaccccacgccagaggtg

SEQ ID NO: 4667 - DNA, 21 bp, Homo sapiens
caagcctccaccccacgccag

SEQ ID NO: 4668 - DNA, 21 bp, Homo sapiens
agcagtggctgtccactgacg

SEQ ID NO: 4669 - DNA, 21 bp, Homo sapiens
tgaggacagacgccagttatc

SEQ ID NO: 4670 - DNA, 21 bp, Homo sapiens
tcattggcagcggcagtgggt

SEQ ID NO: 4671 - DNA, 21 bp, Homo sapiens
aggtgggctgctcatgtccag

SEQ ID NO: 4672 - DNA, 22 bp, Homo sapiens
ccaagactgcagcagccacagc

SEQ ID NO: 4673 - DNA, 21 bp, Homo sapiens
ttacccctgggaccataaaag

SEQ ID NO: 4674 - DNA, 21 bp, Homo sapiens
ctcaccggcggttggttcttc

SEQ ID NO: 4675 - DNA, 21 bp, Homo sapiens
gcagggggagaagctttctct

SEQ ID NO: 4676 - DNA, 21 bp, Homo sapiens
tgcaccccaagaaagctgtat

SEQ ID NO: 4677 - DNA, 21 bp, Homo sapiens
tctctctctctgaatggagac

SEQ ID NO: 4678 - DNA, 21 bp, Homo sapiens
accacctcgtccatcctgaaa

SEQ ID NO: 4679 - DNA, 21 bp, Homo sapiens
tgcccatctcggaggacaagg

SEQ ID NO: 4680 - DNA, 21 bp, Homo sapiens
tggttgtgcctgagggctctg

SEQ ID NO: 4681 - DNA, 21 bp, Homo sapiens
tacctttgaattccatcataa

SEQ ID NO: 4682 - DNA, 21 bp, Homo sapiens
ttagggatttcgcgttgatct

SEQ ID NO: 4683 - DNA, 21 bp, Homo sapiens
gctttgcatggaggaagagca

SEQ ID NO: 4684 - DNA, 21 bp, Homo sapiens
attttgttttgctttccttaa

SEQ ID NO: 4685 - DNA, 21 bp, Homo sapiens
cttctccatcgtcaccagcgt

SEQ ID NO: 4686 - DNA, 21 bp, Homo sapiens
ctctgtttccgcggcaacggc

SEQ ID NO: 4687 - DNA, 21 bp, Homo sapiens
agaagaaagacaagccacacc

SEQ ID NO: 4688 - DNA, 21 bp, Homo sapiens
tcttttacaacgaccgtaacg

SEQ ID NO: 4689 - DNA, 21 bp, Homo sapiens
gaatgggaagtgacctcgttt

SEQ ID NO: 4690 - DNA, 21 bp, Homo sapiens
tccccttccttgttgatcact

SEQ ID NO: 4691 - DNA, 21 bp, Homo sapiens
ttggaaaactgggacgtacaa

SEQ ID NO: 4692 - DNA, 21 bp, Homo sapiens
acaggaacagcgctcgctgca

SEQ ID NO: 4693 - DNA, 21 bp, Homo sapiens
tggaccacaatacccgcacca

SEQ ID NO: 4694 - DNA, 21 bp, Homo sapiens
ctctgcgccgcatgctgcccg

SEQ ID NO: 4695 - DNA, 21 bp, Homo sapiens
ttcacctgctattgttgcaag

SEQ ID NO: 4696 - DNA, 21 bp, Homo sapiens
ggagatgatttctgagatcaa

SEQ ID NO: 4697 - DNA, 21 bp, Homo sapiens
ggccgacccagggtctggaga

SEQ ID NO: 4698 - DNA, 21 bp, Homo sapiens
agggatacgccctaagtcgag

SEQ ID NO: 4699 - DNA, 21 bp, Homo sapiens
gggaggcacggggggcctcct

SEQ ID NO: 4700 - DNA, 21 bp, Homo sapiens
aaaaagtgacaatgcaaatgg

SEQ ID NO: 4701 - DNA, 21 bp, Homo sapiens
atcatcctcgtcatggccctc

SEQ ID NO: 4702 - DNA, 21 bp, Homo sapiens
ccggaccaccctgctggccgg

SEQ ID NO: 4703 - DNA, 21 bp, Homo sapiens
ctgtggcttgagtcctctccc

SEQ ID NO: 4704 - DNA, 21 bp, Homo sapiens
acgctatatccagaatcggtt

SEQ ID NO: 4705 - DNA, 21 bp, Homo sapiens
gctggaaatgcagtggttcag

SEQ ID NO: 4706 - DNA, 21 bp, Homo sapiens
ctggcactgctcttcgtcgct

SEQ ID NO: 4707 - DNA, 21 bp, Homo sapiens
aggaggcacctgtgtgggtgt

SEQ ID NO: 4708 - DNA, 21 bp, Homo sapiens
agcagtccagccccaacctgc

SEQ ID NO: 4709 - DNA, 21 bp, Homo sapiens
ggagcaccaagtgttgctgca

SEQ ID NO: 4710 - DNA, 21 bp, Homo sapiens
ggaggcgctcggagggtgaga

SEQ ID NO: 4711 - DNA, 21 bp, Homo sapiens
atgcgtgcccggaagagcagc

SEQ ID NO: 4712 - DNA, 21 bp, Homo sapiens
agaagaattgaatttttcttt

SEQ ID NO: 4713 - DNA, 21 bp, Homo sapiens
ggatggtgggcggccgcaggg

SEQ ID NO: 4714 - DNA, 21 bp, Homo sapiens
gttggactggcgccaggaccc

SEQ ID NO: 4715 - DNA, 21 bp, Homo sapiens
gttccggcacgtcaaggtgga

SEQ ID NO: 4716 - DNA, 21 bp, Homo sapiens
ataggtcagcgtgtcctgggg

SEQ ID NO: 4717 - DNA, 21 bp, Homo sapiens
ctgtccagttacaacggcgag

SEQ ID NO: 4718 - DNA, 21 bp, Homo sapiens
catgcttgctgtatactatga

SEQ ID NO: 4719 - DNA, 21 bp, Homo sapiens
accacctgccgccgcttcagg

SEQ ID NO: 4720 - DNA, 21 bp, Homo sapiens
aatgaccagcaatggtgttgc

SEQ ID NO: 4721 - DNA, 21 bp, Homo sapiens
gagcagcgtggcgatgaaggc

SEQ ID NO: 4722 - DNA, 21 bp, Homo sapiens
gccagatctccaactatgtgg

SEQ ID NO: 4723 - DNA, 21 bp, Homo sapiens
gcttctcctccgtggacagcg

SEQ ID NO: 4724 - DNA, 21 bp, Homo sapiens
actgctggctgagaactacag

SEQ ID NO: 4725 - DNA, 21 bp, Homo sapiens
gcattcgtcagcacagttggg

SEQ ID NO: 4726 - DNA, 21 bp, Homo sapiens
aagcccgcaggagaccccacg

SEQ ID NO: 4727 - DNA, 21 bp, Homo sapiens
ccaggctgagggcccagagcc

SEQ ID NO: 4728 - DNA, 21 bp, Homo sapiens
cgtgtgacaacgacatgaact

SEQ ID NO: 4729 - DNA, 21 bp, Homo sapiens
ttctgtgtggcagtcttctcg

SEQ ID NO: 4730 - DNA, 21 bp, Homo sapiens
acgacgagaagaagatgttga

SEQ ID NO: 4731 - DNA, 21 bp, Homo sapiens
aacgacgagaagaagatgttg

SEQ ID NO: 4732 - DNA, 21 bp, Homo sapiens
ccatccaagcactctgcagaa

SEQ ID NO: 4733 - DNA, 21 bp, Homo sapiens
ccgtcaaccacgtgtccctta

SEQ ID NO: 4734 - DNA, 21 bp, Homo sapiens
aaatggactccactcatcagt

SEQ ID NO: 4735 - DNA, 21 bp, Homo sapiens
ggcacccacctgctggcctgc

SEQ ID NO: 4736 - DNA, 20 bp, Homo sapiens
aatgccggctcgggggcctt

SEQ ID NO: 4737 - DNA, 21 bp, Homo sapiens
atgtcctgttcctggcagtga

SEQ ID NO: 4738 - DNA, 21 bp, Homo sapiens
cacagctatcatctttgtagt

SEQ ID NO: 4739 - DNA, 23 bp, Homo sapiens
agagttatttttgttcaatgggt

SEQ ID NO: 4740 - DNA, 21 bp, Homo sapiens
caccttcattgtccttcagag

SEQ ID NO: 4741 - DNA, 21 bp, Homo sapiens
ctttcctcaggagcatggcca

SEQ ID NO: 4742 - DNA, 21 bp, Homo sapiens
agagtcagatggaaagaaagc

SEQ ID NO: 4743 - DNA, 21 bp, Homo sapiens
gtccagatccgactcactcag

SEQ ID NO: 4744 - DNA, 21 bp, Homo sapiens
ggaagactgggagctgcaggc

SEQ ID NO: 4745 - DNA, 21 bp, Homo sapiens
catgtgggctctctgagtgat

SEQ ID NO: 4746 - DNA, 21 bp, Homo sapiens
gcgaaggtgcgcgcagtggac

SEQ ID NO: 4747 - DNA, 21 bp, Homo sapiens
cactgctttggtgttagattt

SEQ ID NO: 4748 - DNA, 21 bp, Homo sapiens
ccaccatgttggctttgctgc

SEQ ID NO: 4749 - DNA, 21 bp, Homo sapiens
agatgagctggcattccgctc

SEQ ID NO: 4750 - DNA, 21 bp, Homo sapiens
tccagaggaaagagtagtaca

SEQ ID NO: 4751 - DNA, 21 bp, Homo sapiens
ataagcatgacgacctatgat

SEQ ID NO: 4752 - DNA, 21 bp, Homo sapiens
agttgttctacgctgctgcgt

SEQ ID NO: 4753 - DNA, 21 bp, Homo sapiens
ggtcacctctcggaaaactct

SEQ ID NO: 4754 - DNA, 21 bp, Homo sapiens
gcaggataaaagctggagcca

SEQ ID NO: 4755 - DNA, 21 bp, Homo sapiens
tttgatgaatctttgccagca

SEQ ID NO: 4756 - DNA, 21 bp, Homo sapiens
aaactcgaccctctactttct

SEQ ID NO: 4757 - DNA, 21 bp, Homo sapiens
tgcaaagcaccggcgatgatg

SEQ ID NO: 4758 - DNA, 21 bp, Homo sapiens
ctcgctcctggccgcctcctc

SEQ ID NO: 4759 - DNA, 21 bp, Homo sapiens
tggtggttgacgccagcaagg

SEQ ID NO: 4760 - DNA, 21 bp, Homo sapiens
ggctccaaaccggaaacatcc

SEQ ID NO: 4761 - DNA, 21 bp, Homo sapiens
agcccatctcgctgctcgagg

SEQ ID NO: 4762 - DNA, 21 bp, Homo sapiens
gtccaaagcacgagtggttga

SEQ ID NO: 4763 - DNA, 21 bp, Homo sapiens
cactgggattagtcttccaga

SEQ ID NO: 4764 - DNA, 21 bp, Homo sapiens
tggctgcagacgcatcttctc

SEQ ID NO: 4765 - DNA, 21 bp, Homo sapiens
cttttccggccttgccccgaa

SEQ ID NO: 4766 - DNA, 23 bp, Homo sapiens
ggtatggcggtttgtttactctg

SEQ ID NO: 4767 - DNA, 20 bp, Homo sapiens
tttaatggctgccgctctgg

SEQ ID NO: 4768 - DNA, 21 bp, Homo sapiens
tcctgcctttcggcccgctca

SEQ ID NO: 4769 - DNA, 21 bp, Homo sapiens
ccagttccaagtccttctcgg

SEQ ID NO: 4770 - DNA, 21 bp, Homo sapiens
ttgaagatccccgagatgcag

SEQ ID NO: 4771 - DNA, 21 bp, Homo sapiens
ttgcagcataagtggggaggt

SEQ ID NO: 4772 - DNA, 21 bp, Homo sapiens
gccagtgtgcccatgaggcag

SEQ ID NO: 4773 - DNA, 21 bp, Homo sapiens
cccatcttccccgctcccctc

SEQ ID NO: 4774 - DNA, 21 bp, Homo sapiens
cggccatagcgaatgttttca

SEQ ID NO: 4775 - DNA, 21 bp, Homo sapiens
tttgttcctcgtggcggcgca

SEQ ID NO: 4776 - DNA, 23 bp, Homo sapiens
ttcaccgcccactccagccactg

SEQ ID NO: 4777 - DNA, 22 bp, Homo sapiens
acagccagttcagagtgtcatc

SEQ ID NO: 4778 - DNA, 21 bp, Homo sapiens
cgaagacgcggctgagcccaa

SEQ ID NO: 4779 - DNA, 21 bp, Homo sapiens
ggcggtgcagcccaagcacga

SEQ ID NO: 4780 - DNA, 21 bp, Homo sapiens
tgaaactactcaaaaaatgtg

SEQ ID NO: 4781 - DNA, 21 bp, Homo sapiens
gcggccagcgcggcctggtcg

SEQ ID NO: 4782 - DNA, 21 bp, Homo sapiens
gctctgggaccttttaggggt

SEQ ID NO: 4783 - DNA, 21 bp, Homo sapiens
gggggaccagctggtccaatt

SEQ ID NO: 4784 - DNA, 21 bp, Homo sapiens
cccctactcaccggcaagtat

SEQ ID NO: 4785 - DNA, 21 bp, Homo sapiens
cgacatcagagtgggtaatcc

SEQ ID NO: 4786 - DNA, 21 bp, Homo sapiens
aggagttctgggctcagctga

SEQ ID NO: 4787 - DNA, 20 bp, Homo sapiens
gacgagtggcttgtgagata

SEQ ID NO: 4788 - DNA, 21 bp, Homo sapiens
catacacaaagaacgcagctg

SEQ ID NO: 4789 - DNA, 21 bp, Homo sapiens
tgctgctggacggcgtggaca

SEQ ID NO: 4790 - DNA, 22 bp, Homo sapiens
gtgtggcaggcgatctcaggca

SEQ ID NO: 4791 - DNA, 21 bp, Homo sapiens
tcatctccaacggcataatgg

SEQ ID NO: 4792 - DNA, 21 bp, Homo sapiens
cagatcagatcaggtttatag

SEQ ID NO: 4793 - DNA, 21 bp, Homo sapiens
ctccattagcacacttcacat

SEQ ID NO: 4794 - DNA, 21 bp, Homo sapiens
aagccgcccagtttggtaagt

SEQ ID NO: 4795 - DNA, 20 bp, Homo sapiens
gccagtggctgccgccttct

SEQ ID NO: 4796 - DNA, 21 bp, Homo sapiens
tgcccccaaacacagtaatga

SEQ ID NO: 4797 - DNA, 21 bp, Homo sapiens
acaaaatagccgaaggaatcc

SEQ ID NO: 4798 - DNA, 21 bp, Homo sapiens
ggaggaccgatttgccagtga

SEQ ID NO: 4799 - DNA, 21 bp, Homo sapiens
tatccccagaggagaagaaca

SEQ ID NO: 4800 - DNA, 21 bp, Homo sapiens
gtgctgacacctgggttaacc

SEQ ID NO: 4801 - DNA, 21 bp, Homo sapiens
tcatggtgaacggggtttcca

SEQ ID NO: 4802 - DNA, 20 bp, Homo sapiens
gagaatggcaggggaacaga

SEQ ID NO: 4803 - DNA, 21 bp, Homo sapiens
aggacaaactcaacacaaggt

SEQ ID NO: 4804 - DNA, 21 bp, Homo sapiens
ctactatagcctcctccagaa

SEQ ID NO: 4805 - DNA, 21 bp, Homo sapiens
tgtttccatgctgggagttac

SEQ ID NO: 4806 - DNA, 23 bp, Homo sapiens
ggagcggcttcagtagctgaaac

SEQ ID NO: 4807 - DNA, 21 bp, Homo sapiens
cccctgctgatgggtggacag

SEQ ID NO: 4808 - DNA, 21 bp, Homo sapiens
aacattccacgaacccattgg

SEQ ID NO: 4809 - DNA, 21 bp, Homo sapiens
gtagtcctttttttatctggt

SEQ ID NO: 4810 - DNA, 21 bp, Homo sapiens
ggtactcagcgctgctggcaa

SEQ ID NO: 4811 - DNA, 21 bp, Homo sapiens
gcttctctcttggttcggtgt

SEQ ID NO: 4812 - DNA, 21 bp, Homo sapiens
actgtggaggcttttattgaa

SEQ ID NO: 4813 - DNA, 21 bp, Homo sapiens
agatggtacgcaggtctgtgg

SEQ ID NO: 4814 - DNA, 21 bp, Homo sapiens
caatgaaaaacagatgtaccc

SEQ ID NO: 4815 - DNA, 21 bp, Homo sapiens
atcgggcagcggctgcggcgg

SEQ ID NO: 4816 - DNA, 21 bp, Homo sapiens
ttggttggaacgctatgatga

SEQ ID NO: 4817 - DNA, 21 bp, Homo sapiens
ctgaaaccgttctgcttctgt

SEQ ID NO: 4818 - DNA, 21 bp, Homo sapiens
gacccgaggacgccctcagac

SEQ ID NO: 4819 - DNA, 21 bp, Homo sapiens
agcggtgctcgccacttgcct

SEQ ID NO: 4820 - DNA, 21 bp, Homo sapiens
tgggggagccgggggcatctg

SEQ ID NO: 4821 - DNA, 21 bp, Homo sapiens
tgtccagggcggaaagtacag

SEQ ID NO: 4822 - DNA, 21 bp, Homo sapiens
ctgagggcaccgtctacttca

SEQ ID NO: 4823 - DNA, 21 bp, Homo sapiens
gtcgctgccgctcctggtgtt

SEQ ID NO: 4824 - DNA, 21 bp, Homo sapiens
aggcctaagacgacaccccaa

SEQ ID NO: 4825 - DNA, 21 bp, Homo sapiens
gtaggggagcggctcctccgg

SEQ ID NO: 4826 - DNA, 21 bp, Homo sapiens
aaggatacccgaaccaggtca

SEQ ID NO: 4827 - DNA, 21 bp, Homo sapiens
caggagcgagcggtcggggag

SEQ ID NO: 4828 - DNA, 21 bp, Homo sapiens
cttgaggtgcgtcgcgccccc

SEQ ID NO: 4829 - DNA, 21 bp, Homo sapiens
cttgaaaacctttaccaatac

SEQ ID NO: 4830 - DNA, 21 bp, Homo sapiens
gaagagggggcgcaggagccc

SEQ ID NO: 4831 - DNA, 22 bp, Homo sapiens
gctgaacttcgtgcggctcctc

SEQ ID NO: 4832 - DNA, 21 bp, Homo sapiens
cgaagggtgcggcctcgtcgg

SEQ ID NO: 4833 - DNA, 21 bp, Homo sapiens
tgaatcccaagagttcgcttt

SEQ ID NO: 4834 - DNA, 21 bp, Homo sapiens
ttttacctttccaggtggaac

SEQ ID NO: 4835 - DNA, 21 bp, Homo sapiens
gacgtatctcgccgaaaggct

SEQ ID NO: 4836 - DNA, 21 bp, Homo sapiens
ttttctatacaatattccaag

SEQ ID NO: 4837 - DNA, 21 bp, Homo sapiens
agaggggttcatcattaacac

SEQ ID NO: 4838 - DNA, 21 bp, Homo sapiens
gcggccgagccgggctacctg

SEQ ID NO: 4839 - DNA, 21 bp, Homo sapiens
tctatggcaggtttgatttat

SEQ ID NO: 4840 - DNA, 21 bp, Homo sapiens
tccaggtggtgggggaggagg

SEQ ID NO: 4841 - DNA, 21 bp, Homo sapiens
gtcaatgtaggagctctatca

SEQ ID NO: 4842 - DNA, 21 bp, Homo sapiens
caggctcccagagcctcaggc

SEQ ID NO: 4843 - DNA, 21 bp, Homo sapiens
gcccagaggaggacattgctg

SEQ ID NO: 4844 - DNA, 21 bp, Homo sapiens
ctaggcaacatccctgtggga

SEQ ID NO: 4845 - DNA, 21 bp, Homo sapiens
aggtaaccgcggcgctgggtc

SEQ ID NO: 4846 - DNA, 21 bp, Homo sapiens
ggatagcctccgacccaacaa

SEQ ID NO: 4847 - DNA, 21 bp, Homo sapiens
tgctcatcaacgacaaggtga

SEQ ID NO: 4848 - DNA, 21 bp, Homo sapiens
cagggccttctcactgggtgg

SEQ ID NO: 4849 - DNA, 21 bp, Homo sapiens
tgccaggaccgtgccccccga

SEQ ID NO: 4850 - DNA, 21 bp, Homo sapiens
ataaaaaagccacacagagga

SEQ ID NO: 4851 - DNA, 21 bp, Homo sapiens
caagaaagggaaggagaaaga

SEQ ID NO: 4852 - DNA, 21 bp, Homo sapiens
atgatccttggtggggactgt

SEQ ID NO: 4853 - DNA, 21 bp, Homo sapiens
cccccatagcgtttgtacagg

SEQ ID NO: 4854 - DNA, 21 bp, Homo sapiens
ggaacagggcgtagagggcga

SEQ ID NO: 4855 - DNA, 21 bp, Homo sapiens
ttattcaactcttccagctgg

SEQ ID NO: 4856 - DNA, 21 bp, Homo sapiens
gctcacaaccgtcagcaactt

SEQ ID NO: 4857 - DNA, 21 bp, Homo sapiens
ctgtcaatgtcctgtagaaaa

SEQ ID NO: 4858 - DNA, 21 bp, Homo sapiens
ttggaaatacttttgtcccat

SEQ ID NO: 4859 - DNA, 21 bp, Homo sapiens
tgtggaggtcggagctccggc

SEQ ID NO: 4860 - DNA, 21 bp, Homo sapiens
gcgcgcgtgccgagaccgagg

SEQ ID NO: 4861 - DNA, 21 bp, Homo sapiens
tgggaagcccgcatgttccca

SEQ ID NO: 4862 - DNA, 21 bp, Homo sapiens
aacttataacgatgttccata

SEQ ID NO: 4863 - DNA, 21 bp, Homo sapiens
ggaagatctagaagggatggc

SEQ ID NO: 4864 - DNA, 21 bp, Homo sapiens
tgcacaagccggaagacgtga

SEQ ID NO: 4865 - DNA, 21 bp, Homo sapiens
attgtggtgccggcgtccgcg

SEQ ID NO: 4866 - DNA, 21 bp, Homo sapiens
agggaatgccaatgagctcat

SEQ ID NO: 4867 - DNA, 21 bp, Homo sapiens
ccatattgcagtagtaatatt

SEQ ID NO: 4868 - DNA, 21 bp, Homo sapiens
cgagatcttcgccaagcgcgc

SEQ ID NO: 4869 - DNA, 21 bp, Homo sapiens
cccccgccactgccgggcggg

SEQ ID NO: 4870 - DNA, 21 bp, Homo sapiens
ccacccgggtggagatagtgt

SEQ ID NO: 4871 - DNA, 22 bp, Homo sapiens
cttgtggcttgattgcaaagtc

SEQ ID NO: 4872 - DNA, 21 bp, Homo sapiens
cctgagggtgctcatctgggc

SEQ ID NO: 4873 - DNA, 20 bp, Homo sapiens
agtactggctggcctgctta

SEQ ID NO: 4874 - DNA, 21 bp, Homo sapiens
gtgtccttcggacactcctga

SEQ ID NO: 4875 - DNA, 21 bp, Homo sapiens
cgtccatttccccagagtcac

SEQ ID NO: 4876 - DNA, 21 bp, Homo sapiens
agctgcctgtggagtgagttg

SEQ ID NO: 4877 - DNA, 21 bp, Homo sapiens
cttattccatccggaccgcat

SEQ ID NO: 4878 - DNA, 22 bp, Homo sapiens
agtggctgggcaggcagtgccc

SEQ ID NO: 4879 - DNA, 21 bp, Homo sapiens
aaagccgccgcgtggcccagg

SEQ ID NO: 4880 - DNA, 21 bp, Homo sapiens
ggcttttgaccgctttgtggc

SEQ ID NO: 4881 - DNA, 21 bp, Homo sapiens
agctcgccatcccacgtactg

SEQ ID NO: 4882 - DNA, 21 bp, Homo sapiens
tgggctatatctgcggtgaaa

SEQ ID NO: 4883 - DNA, 22 bp, Homo sapiens
ctatggctccagctgtgctgtg

SEQ ID NO: 4884 - DNA, 21 bp, Homo sapiens
gcacatgcacgtttgcaatcc

SEQ ID NO: 4885 - DNA, 21 bp, Homo sapiens
ggggagcagtcgtccacgttg

SEQ ID NO: 4886 - DNA, 21 bp, Homo sapiens
atgtctctccgcagacatcct

SEQ ID NO: 4887 - DNA, 20 bp, Homo sapiens
aggtatggctgttccgcctc

SEQ ID NO: 4888 - DNA, 21 bp, Homo sapiens
cctgtggtggtgcgatattcc

SEQ ID NO: 4889 - DNA, 21 bp, Homo sapiens
ggataaataacggccaaccag

SEQ ID NO: 4890 - DNA, 21 bp, Homo sapiens
gctacggctacgagtacatgg

SEQ ID NO: 4891 - DNA, 21 bp, Homo sapiens
tacagcttacggtaaacaaca

SEQ ID NO: 4892 - DNA, 22 bp, Homo sapiens
gagaagccccccaactcatcct

SEQ ID NO: 4893 - DNA, 20 bp, Homo sapiens
agtagtggctgcaagaggct

SEQ ID NO: 4894 - DNA, 21 bp, Homo sapiens
ggccagtaatccacaggtgtt

SEQ ID NO: 4895 - DNA, 21 bp, Homo sapiens
agcacgactttcatctttcct

SEQ ID NO: 4896 - DNA, 21 bp, Homo sapiens
agcacacgccggatggtcagc

SEQ ID NO: 4897 - DNA, 21 bp, Homo sapiens
tggcatctgacgagctgatgc

SEQ ID NO: 4898 - DNA, 22 bp, Homo sapiens
taagttgtgcatcaccagccac

SEQ ID NO: 4899 - DNA, 21 bp, Homo sapiens
tcatctacaacggcacgcttg

SEQ ID NO: 4900 - DNA, 20 bp, Homo sapiens
ggcgagtggcggcccaggca

SEQ ID NO: 4901 - DNA, 21 bp, Homo sapiens
cccgagacatcacgacctcaa

SEQ ID NO: 4902 - DNA, 21 bp, Homo sapiens
agctcaacccattttcctgct

SEQ ID NO: 4903 - DNA, 22 bp, Homo sapiens
ggagcggcggctgaggctgagt

SEQ ID NO: 4904 - DNA, 20 bp, Homo sapiens
cactgtggctgcttttcccc

SEQ ID NO: 4905 - DNA, 21 bp, Homo sapiens
cagctgatgacgactatgggc

SEQ ID NO: 4906 - DNA, 21 bp, Homo sapiens
gcagttcttccaatgagagat

SEQ ID NO: 4907 - DNA, 21 bp, Homo sapiens
ggaagcgctctttgtgaagga

SEQ ID NO: 4908 - DNA, 21 bp, Homo sapiens
gatctgttggcggatgagctg

SEQ ID NO: 4909 - DNA, 21 bp, Homo sapiens
gggcctgttcgccttctgctg

SEQ ID NO: 4910 - DNA, 21 bp, Homo sapiens
agcaggccgcggagctcttca

SEQ ID NO: 4911 - DNA, 21 bp, Homo sapiens
tggtggctgatgatggtgtga

SEQ ID NO: 4912 - DNA, 21 bp, Homo sapiens
cggaagagccttgggagcacg

SEQ ID NO: 4913 - DNA, 21 bp, Homo sapiens
cctgagcccagaaggtatcac

SEQ ID NO: 4914 - DNA, 21 bp, Homo sapiens
tgctgcttcgcgctcccgctg

SEQ ID NO: 4915 - DNA, 21 bp, Homo sapiens
ggcctcctacctctttatcat

SEQ ID NO: 4916 - DNA, 21 bp, Homo sapiens
cttcgaaaccgttatggtgaa

SEQ ID NO: 4917 - DNA, 21 bp, Homo sapiens
ggaactggcacgactccgtca

SEQ ID NO: 4918 - DNA, 21 bp, Homo sapiens
tggccaaggcggaggacaccg

SEQ ID NO: 4919 - DNA, 21 bp, Homo sapiens
caggacatcaaacagcctccg

SEQ ID NO: 4920 - DNA, 21 bp, Homo sapiens
ttcttccagacgaccgccatg

SEQ ID NO: 4921 - DNA, 20 bp, Homo sapiens
gatactggctaccgtgacct

SEQ ID NO: 4922 - DNA, 21 bp, Homo sapiens
gttaccaccaaaaagtctcgt

SEQ ID NO: 4923 - DNA, 21 bp, Homo sapiens
tgagagtgtgtaactgagagg

SEQ ID NO: 4924 - DNA, 21 bp, Homo sapiens
cttgaatacattgatctggtc

SEQ ID NO: 4925 - DNA, 21 bp, Homo sapiens
agctgactgagtgtcagctcg

SEQ ID NO: 4926 - DNA, 21 bp, Homo sapiens
gcgatgagcgcgccgcacaga

SEQ ID NO: 4927 - DNA, 21 bp, Homo sapiens
gtaattcttagagagattcct

SEQ ID NO: 4928 - DNA, 21 bp, Homo sapiens
gccatctttccgagtcatgat

SEQ ID NO: 4929 - DNA, 21 bp, Homo sapiens
ggagcttcaggctgtgaagag

SEQ ID NO: 4930 - DNA, 21 bp, Homo sapiens
actaatttacgttttatatca

SEQ ID NO: 4931 - DNA, 21 bp, Homo sapiens
tagaaaacctcaattgtttca

SEQ ID NO: 4932 - DNA, 21 bp, Homo sapiens
cgggagctgcacctgcaggac

SEQ ID NO: 4933 - DNA, 21 bp, Homo sapiens
aggacaacaacgagcgcagca

SEQ ID NO: 4934 - DNA, 21 bp, Homo sapiens
gagctgacagggggctcagaa

SEQ ID NO: 4935 - DNA, 21 bp, Homo sapiens
tttttggacatgccctcgagg

SEQ ID NO: 4936 - DNA, 21 bp, Homo sapiens
tgcctccagccgcgcactgaa

SEQ ID NO: 4937 - DNA, 21 bp, Homo sapiens
tgctgggctcgcgctgggaga

SEQ ID NO: 4938 - DNA, 21 bp, Homo sapiens
agggcgaggacggacaggtgg

SEQ ID NO: 4939 - DNA, 21 bp, Homo sapiens
tggtccttccgcagctgatca

SEQ ID NO: 4940 - DNA, 21 bp, Homo sapiens
gtgatccttcgctacgccaag

SEQ ID NO: 4941 - DNA, 21 bp, Homo sapiens
ggccttggactggagggtggc

SEQ ID NO: 4942 - DNA, 21 bp, Homo sapiens
tacacccaccgcgattacggc

SEQ ID NO: 4943 - DNA, 21 bp, Homo sapiens
taggggtgccgtataatctgt

SEQ ID NO: 4944 - DNA, 20 bp, Homo sapiens
ggtcacaggcttggcagctg

SEQ ID NO: 4945 - DNA, 21 bp, Homo sapiens
cactacatttttttctggagg

SEQ ID NO: 4946 - DNA, 21 bp, Homo sapiens
tcggagctgtcgaatccgccc

SEQ ID NO: 4947 - DNA, 21 bp, Homo sapiens
atgaggcagcgtctggccgag

SEQ ID NO: 4948 - DNA, 21 bp, Homo sapiens
cccgcagggcgcgctccatca

SEQ ID NO: 4949 - DNA, 20 bp, Homo sapiens
gaaagtggcagccgggccgc

SEQ ID NO: 4950 - DNA, 21 bp, Homo sapiens
gagaaaataaataagataaaa

SEQ ID NO: 4951 - DNA, 21 bp, Homo sapiens
accagatcttgatctggcgct

SEQ ID NO: 4952 - DNA, 21 bp, Homo sapiens
atctatacgcgaagaaattat

SEQ ID NO: 4953 - DNA, 20 bp, Homo sapiens
ggaaagtggcggggagaaga

SEQ ID NO: 4954 - DNA, 21 bp, Homo sapiens
gagggggtgcggacccagaaa

SEQ ID NO: 4955 - DNA, 21 bp, Homo sapiens
gcatctcgcaaaagaagtggt

SEQ ID NO: 4956 - DNA, 21 bp, Homo sapiens
aagcggcctcgcaactcttat

SEQ ID NO: 4957 - DNA, 21 bp, Homo sapiens
atgcagatgtctccagccctc

SEQ ID NO: 4958 - DNA, 21 bp, Homo sapiens
gattttggaagatgttgtggt

SEQ ID NO: 4959 - DNA, 21 bp, Homo sapiens
tcgccaccatcggcagcacct

SEQ ID NO: 4960 - DNA, 21 bp, Homo sapiens
tgagaaaaatcgagttcccag

SEQ ID NO: 4961 - DNA, 21 bp, Homo sapiens
caacaaccaccgcgaggtggc

SEQ ID NO: 4962 - DNA, 21 bp, Homo sapiens
gtgaagttacgaaaattggag

SEQ ID NO: 4963 - DNA, 23 bp, Homo sapiens
ggttactgcctcacctgccaatg

SEQ ID NO: 4964 - DNA, 21 bp, Homo sapiens
tatctaccaggtgagcagcta

SEQ ID NO: 4965 - DNA, 21 bp, Homo sapiens
tggaactaccgttcattatgt

SEQ ID NO: 4966 - DNA, 21 bp, Homo sapiens
ctgcgtgggcgggatgcccag

SEQ ID NO: 4967 - DNA, 21 bp, Homo sapiens
atcgactcacatctgcgggat

SEQ ID NO: 4968 - DNA, 21 bp, Homo sapiens
gcaggagcccgcgtgacgatc

SEQ ID NO: 4969 - DNA, 21 bp, Homo sapiens
gaacaagtgagccagctctct

SEQ ID NO: 4970 - DNA, 20 bp, Homo sapiens
cacggggcccgccacggtca

SEQ ID NO: 4971 - DNA, 21 bp, Homo sapiens
ctttaacttgctcccaattaa

SEQ ID NO: 4972 - DNA, 20 bp, Homo sapiens
aggaatcggcttgggtggct

SEQ ID NO: 4973 - DNA, 21 bp, Homo sapiens
ttttggggagctgcagactgt

SEQ ID NO: 4974 - DNA, 21 bp, Homo sapiens
ccctgcagatcggtggcaatc

SEQ ID NO: 4975 - DNA, 21 bp, Homo sapiens
ctcttacatcactggcaatat

SEQ ID NO: 4976 - DNA, 20 bp, Homo sapiens
tacttgcggcggccgagctc

SEQ ID NO: 4977 - DNA, 22 bp, Homo sapiens
gcagtggcagctgtggttgtat

SEQ ID NO: 4978 - DNA, 21 bp, Homo sapiens
catggtggaggtgcagctgga

SEQ ID NO: 4979 - DNA, 21 bp, Homo sapiens
actggagcactgggggaaccc

SEQ ID NO: 4980 - DNA, 21 bp, Homo sapiens
acaaagctggcgttggatttc

SEQ ID NO: 4981 - DNA, 21 bp, Homo sapiens
gagcgtccgggtaccgctgag

SEQ ID NO: 4982 - DNA, 21 bp, Homo sapiens
tgaatgctccacttcttccat

SEQ ID NO: 4983 - DNA, 21 bp, Homo sapiens
tgtctgatatgaagcactccg

SEQ ID NO: 4984 - DNA, 21 bp, Homo sapiens
gcggcgtggggagtccctttt

SEQ ID NO: 4985 - DNA, 21 bp, Homo sapiens
catgtgaccattcacccgatt

SEQ ID NO: 4986 - DNA, 21 bp, Homo sapiens
gaacatcttctcatacactgc

SEQ ID NO: 4987 - DNA, 21 bp, Homo sapiens
cggcaaaatctggcccacaag

SEQ ID NO: 4988 - DNA, 21 bp, Homo sapiens
ctggccagtgcgccctgcagc

SEQ ID NO: 4989 - DNA, 21 bp, Homo sapiens
gcaaaatctggcccacaagtc

SEQ ID NO: 4990 - DNA, 21 bp, Homo sapiens
ctccatggccgctcttcctgg

SEQ ID NO: 4991 - DNA, 21 bp, Homo sapiens
aaaatctggacgcctgacacc

SEQ ID NO: 4992 - DNA, 21 bp, Homo sapiens
acaggtacttccatttgcaca

SEQ ID NO: 4993 - DNA, 21 bp, Homo sapiens
gcaacaggtacgggtcttttt

SEQ ID NO: 4994 - DNA, 21 bp, Homo sapiens
aggatcatattcttgtgaaag

SEQ ID NO: 4995 - DNA, 21 bp, Homo sapiens
gcatgtaaaggactctctccg

SEQ ID NO: 4996 - DNA, 21 bp, Homo sapiens
aatactattatcctaatttcc

SEQ ID NO: 4997 - DNA, 21 bp, Homo sapiens
cctgcgcccccctgtatgatg

SEQ ID NO: 4998 - DNA, 21 bp, Homo sapiens
ccctgcgcccccctgtatgat

SEQ ID NO: 4999 - DNA, 21 bp, Homo sapiens
agaaagctgtgagtgtgcgtc

SEQ ID NO: 5000 - DNA, 21 bp, Homo sapiens
tgaatgggaagtgacctcgtt

SEQ ID NO: 5001 - DNA, 21 bp, Homo sapiens
tttttttcccaggatttcctg

SEQ ID NO: 5002 - DNA, 21 bp, Homo sapiens
agatggtcaatgcggcgtcct

SEQ ID NO: 5003 - DNA, 21 bp, Homo sapiens
caggacccttccacgggctgc

SEQ ID NO: 5004 - DNA, 21 bp, Homo sapiens
ggggcagcaacaccaccagcc

SEQ ID NO: 5005 - DNA, 21 bp, Homo sapiens
aacctcatgtttgccttcttt

SEQ ID NO: 5006 - DNA, 21 bp, Homo sapiens
acagcatgtgtaatctcctag

SEQ ID NO: 5007 - DNA, 21 bp, Homo sapiens
caccccaaccgttcagccctc

SEQ ID NO: 5008 - DNA, 21 bp, Homo sapiens
tggtgaagcgcgtggtgttgg

SEQ ID NO: 5009 - DNA, 21 bp, Homo sapiens
gtggaatgcttccgccgtctc

SEQ ID NO: 5010 - DNA, 21 bp, Homo sapiens
tactaccagagtatattgttg

SEQ ID NO: 5011 - DNA, 21 bp, Homo sapiens
ttggcattgacgtgcaagtcg

SEQ ID NO: 5012 - DNA, 23 bp, Homo sapiens
ttagaggcttgaatttgatatct

SEQ ID NO: 5013 - DNA, 21 bp, Homo sapiens
actccatcaagacaatccagg

SEQ ID NO: 5014 - DNA, 21 bp, Homo sapiens
cgttctgacactcgtcaatat

SEQ ID NO: 5015 - DNA, 21 bp, Homo sapiens
atgatgtggcggtggtggacc

SEQ ID NO: 5016 - DNA, 21 bp, Homo sapiens
catcatcctcgtcatggccct

SEQ ID NO: 5017 - DNA, 21 bp, Homo sapiens
cgctggaaatgcagtggttca

SEQ ID NO: 5018 - DNA, 21 bp, Homo sapiens
cagccacaagcttgtcttgaa

SEQ ID NO: 5019 - DNA, 21 bp, Homo sapiens
tggcactgctcttcgtcgctg

SEQ ID NO: 5020 - DNA, 21 bp, Homo sapiens
aaaccggatgctgagtaccct

SEQ ID NO: 5021 - DNA, 21 bp, Homo sapiens
ttatgaaagacgtttgcatat

SEQ ID NO: 5022 - DNA, 21 bp, Homo sapiens
ccctttcaccgttttcttcct

SEQ ID NO: 5023 - DNA, 21 bp, Homo sapiens
ctcggagtttcctttcaacag

SEQ ID NO: 5024 - DNA, 21 bp, Homo sapiens
acttgaggttgaagtcatcca

SEQ ID NO: 5025 - DNA, 22 bp, Homo sapiens
cttttcaatttctgcttcaaag

SEQ ID NO: 5026 - DNA, 21 bp, Homo sapiens
ccccttcgtccctgtgagctg

SEQ ID NO: 5027 - DNA, 21 bp, Homo sapiens
accttcctctgcaagctggtc

SEQ ID NO: 5028 - DNA, 21 bp, Homo sapiens
ccaggcccacagctgccacta

SEQ ID NO: 5029 - DNA, 21 bp, Homo sapiens
tcatagtatacagcaagcatg

SEQ ID NO: 5030 - DNA, 21 bp, Homo sapiens
tgtcaaagccggaaagatcat

SEQ ID NO: 5031 - DNA, 21 bp, Homo sapiens
aagatgtaaaatatgccctac

SEQ ID NO: 5032 - DNA, 21 bp, Homo sapiens
ccagatctccaactatgtggc

SEQ ID NO: 5033 - DNA, 21 bp, Homo sapiens
tgccaaactgcgagaagtgct

SEQ ID NO: 5034 - DNA, 21 bp, Homo sapiens
ttggtcatccgggtgacatgg

SEQ ID NO: 5035 - DNA, 21 bp, Homo sapiens
tggagcccaacgagatgatgc

SEQ ID NO: 5036 - DNA, 21 bp, Homo sapiens
atggagcccaacgagatgatg

SEQ ID NO: 5037 - DNA, 21 bp, Homo sapiens
attgcaaggctgctcgccgaa

SEQ ID NO: 5038 - DNA, 21 bp, Homo sapiens
gtggcggtccgccacttggcg

SEQ ID NO: 5039 - DNA, 20 bp, Homo sapiens
gattgtggctggctatgcta

SEQ ID NO: 5040 - DNA, 20 bp, Homo sapiens
gttagcggctcgggccgagg

SEQ ID NO: 5041 - DNA, 21 bp, Homo sapiens
ataagcatgacgacctatgat

SEQ ID NO: 5042 - DNA, 21 bp, Homo sapiens
gaaattttgagtcgtttcttc

SEQ ID NO: 5043 - DNA, 21 bp, Homo sapiens
ctcactttccatatctgtatc

SEQ ID NO: 5044 - DNA, 21 bp, Homo sapiens
agttaggtttgaatgttcact

SEQ ID NO: 5045 - DNA, 21 bp, Homo sapiens
taccagaatgtgtgcacgcaa

SEQ ID NO: 5046 - DNA, 21 bp, Homo sapiens
gcattccaacgtcaacagcca

SEQ ID NO: 5047 - DNA, 21 bp, Homo sapiens
ccccattcctggggctctggg

SEQ ID NO: 5048 - DNA, 21 bp, Homo sapiens
aaggtctggaacaagattcag

SEQ ID NO: 5049 - DNA, 21 bp, Homo sapiens
cagtgcactgagatgccccca

SEQ ID NO: 5050 - DNA, 21 bp, Homo sapiens
acatagtcatcaagcgtggct

SEQ ID NO: 5051 - DNA, 21 bp, Homo sapiens
aatggactccactcatcagtt

SEQ ID NO: 5052 - DNA, 21 bp, Homo sapiens
cttggagcacggatatttttc

SEQ ID NO: 5053 - DNA, 21 bp, Homo sapiens
ccagtatggatcacctgatgg

SEQ ID NO: 5054 - DNA, 21 bp, Homo sapiens
tttcatttttgtgactgtact

SEQ ID NO: 5055 - DNA, 20 bp, Homo sapiens
agcctatggcttgcctgtct

SEQ ID NO: 5056 - DNA, 21 bp, Homo sapiens
tttctgtagcgttcttggcgg

SEQ ID NO: 5057 - DNA, 21 bp, Homo sapiens
gcttcagcccgtaccttggga

SEQ ID NO: 5058 - DNA, 21 bp, Homo sapiens
gtggaggctcggtgcaaagtg

SEQ ID NO: 5059 - DNA, 21 bp, Homo sapiens
aacaaggccttcaatgaggtg

SEQ ID NO: 5060 - DNA, 21 bp, Homo sapiens
acatttttggtaataatgatg

SEQ ID NO: 5061 - DNA, 21 bp, Homo sapiens
gcagggagtggcctggtcact

SEQ ID NO: 5062 - DNA, 21 bp, Homo sapiens
ctcatacggcagcagcacgag

SEQ ID NO: 5063 - DNA, 21 bp, Homo sapiens
gctcatacggcagcagcacga

SEQ ID NO: 5064 - DNA, 21 bp, Homo sapiens
cacctcttcggggagatgtag

SEQ ID NO: 5065 - DNA, 21 bp, Homo sapiens
tccatcacagcctcagactcg

SEQ ID NO: 5066 - DNA, 21 bp, Homo sapiens
agtcaggaggtcatgtttgtg

SEQ ID NO: 5067 - DNA, 21 bp, Homo sapiens
agaagtacgcaaggaaagtca

SEQ ID NO: 5068 - DNA, 21 bp, Homo sapiens
aatggcttggcgccaggtaag

SEQ ID NO: 5069 - DNA, 21 bp, Homo sapiens
agctaccggcccaacgtggcc

SEQ ID NO: 5070 - DNA, 20 bp, Homo sapiens
atcagtggcaggaagggcca

SEQ ID NO: 5071 - DNA, 23 bp, Homo sapiens
acactggcttgcctcctcctagc

SEQ ID NO: 5072 - DNA, 21 bp, Homo sapiens
ttcactgctcctttattcctc

SEQ ID NO: 5073 - DNA, 21 bp, Homo sapiens
gggacgtgttcgggcttcgag

SEQ ID NO: 5074 - DNA, 21 bp, Homo sapiens
gggtcaatgcaccaggcctgg

SEQ ID NO: 5075 - DNA, 21 bp, Homo sapiens
ttgacatggccgttggccagg

SEQ ID NO: 5076 - DNA, 21 bp, Homo sapiens
agctcttactattctgtccac

SEQ ID NO: 5077 - DNA, 21 bp, Homo sapiens
tttgctgcagtaggaaggcat

SEQ ID NO: 5078 - DNA, 21 bp, Homo sapiens
gcctgtcagcaccacatcggt

SEQ ID NO: 5079 - DNA, 21 bp, Homo sapiens
atatagcctgcgtaaattagt

SEQ ID NO: 5080 - DNA, 21 bp, Homo sapiens
gagttaagcgcgcgtcttcat

SEQ ID NO: 5081 - DNA, 21 bp, Homo sapiens
agccaagaatacgctctccat

SEQ ID NO: 5082 - DNA, 21 bp, Homo sapiens
tctgaagtgtttgacctggaa

SEQ ID NO: 5083 - DNA, 21 bp, Homo sapiens
gaaacctgggcgactgacaac

SEQ ID NO: 5084 - DNA, 21 bp, Homo sapiens
ttgtggcagcaccagccactt

SEQ ID NO: 5085 - DNA, 21 bp, Homo sapiens
gggtcagcgcgtaggtagtca

SEQ ID NO: 5086 - DNA, 21 bp, Homo sapiens
ggccaacgagagcttggagag

SEQ ID NO: 5087 - DNA, 21 bp, Homo sapiens
caacagtttttaatgaaactt

SEQ ID NO: 5088 - DNA, 21 bp, Homo sapiens
tcttttctgtctctgattcgt

SEQ ID NO: 5089 - DNA, 21 bp, Homo sapiens
ataaaattcacaatgtggccc

SEQ ID NO: 5090 - DNA, 21 bp, Homo sapiens
atttgcgaggcatggaaacag

SEQ ID NO: 5091 - DNA, 21 bp, Homo sapiens
gggacacgacgtcagtactga

SEQ ID NO: 5092 - DNA, 23 bp, Homo sapiens
ccccgcttgactcaagccgctac

SEQ ID NO: 5093 - DNA, 21 bp, Homo sapiens
gagccctcagggcatattgag

SEQ ID NO: 5094 - DNA, 21 bp, Homo sapiens
ctgctgcccacgcccccgctg

SEQ ID NO: 5095 - DNA, 21 bp, Homo sapiens
ttgcccccgaggtgagtgcag

SEQ ID NO: 5096 - DNA, 21 bp, Homo sapiens
caggagttcatccgctgcatc

SEQ ID NO: 5097 - DNA, 21 bp, Homo sapiens
tggcttatgcagcactggtga

SEQ ID NO: 5098 - DNA, 21 bp, Homo sapiens
tggggtcaaagatcccagaaa

SEQ ID NO: 5099 - DNA, 21 bp, Homo sapiens
aagacatcctgctggagtctc

SEQ ID NO: 5100 - DNA, 21 bp, Homo sapiens
tgaatttggacgacagccagt

SEQ ID NO: 5101 - DNA, 21 bp, Homo sapiens
gccagacagccggcaggaggt

SEQ ID NO: 5102 - DNA, 21 bp, Homo sapiens
tccctgttccgcgtgctactt

SEQ ID NO: 5103 - DNA, 21 bp, Homo sapiens
acgagttgtgactgaaacctt

SEQ ID NO: 5104 - DNA, 21 bp, Homo sapiens
aagtcttcccggacaaaatga

SEQ ID NO: 5105 - DNA, 21 bp, Homo sapiens
tcaagtttgacggcaggcagg

SEQ ID NO: 5106 - DNA, 21 bp, Homo sapiens
acattgccactgcagatgagc

SEQ ID NO: 5107 - DNA, 20 bp, Homo sapiens
agttgtggctgttaaagaga

SEQ ID NO: 5108 - DNA, 21 bp, Homo sapiens
gcttcttggcctgaccgatga

SEQ ID NO: 5109 - DNA, 21 bp, Homo sapiens
tcaagaaagtgtactgttgtg

SEQ ID NO: 5110 - DNA, 21 bp, Homo sapiens
aacaagcagtcggcgcaagaa

SEQ ID NO: 5111 - DNA, 21 bp, Homo sapiens
gctccactccgtgcaccccgc

SEQ ID NO: 5112 - DNA, 23 bp, Homo sapiens
gaattggcttgactagcaagtat

SEQ ID NO: 5113 - DNA, 21 bp, Homo sapiens
atggcgtgatcgtggtattca

SEQ ID NO: 5114 - DNA, 21 bp, Homo sapiens
gcccaggccagcttacctcaa

SEQ ID NO: 5115 - DNA, 21 bp, Homo sapiens
tccagggcgctctgctcatcc

SEQ ID NO: 5116 - DNA, 21 bp, Homo sapiens
ctgtcacacactccttctgtc

SEQ ID NO: 5117 - DNA, 21 bp, Homo sapiens
ttatgtcaagcgctttaacta

SEQ ID NO: 5118 - DNA, 20 bp, Homo sapiens
cgatattggcttggggtctg

SEQ ID NO: 5119 - DNA, 21 bp, Homo sapiens
aggtgctcaaggcccacctta

SEQ ID NO: 5120 - DNA, 21 bp, Homo sapiens
ttttcctccacggacaaatgc

SEQ ID NO: 5121 - DNA, 21 bp, Homo sapiens
gttttgagatttccttatgca

SEQ ID NO: 5122 - DNA, 21 bp, Homo sapiens
gtccccttcacggttcggcag

SEQ ID NO: 5123 - DNA, 21 bp, Homo sapiens
cgtggcgctgcgccactgcct

SEQ ID NO: 5124 - DNA, 21 bp, Homo sapiens
cctccagttcagcaaggggtc

SEQ ID NO: 5125 - DNA, 21 bp, Homo sapiens
tcctggagtgcgacttcctct

SEQ ID NO: 5126 - DNA, 21 bp, Homo sapiens
gaattcacctgcagagctcag

SEQ ID NO: 5127 - DNA, 21 bp, Homo sapiens
tggtggcttaaagtaggaata

SEQ ID NO: 5128 - DNA, 21 bp, Homo sapiens
ggctggaggcgaggcttcagg

SEQ ID NO: 5129 - DNA, 21 bp, Homo sapiens
ccaatcagcgcttcatccccg

SEQ ID NO: 5130 - DNA, 21 bp, Homo sapiens
cctggtgtgtgtagaggcggc

SEQ ID NO: 5131 - DNA, 20 bp, Homo sapiens
gcgtcacggcgggcccctgc

SEQ ID NO: 5132 - DNA, 21 bp, Homo sapiens
tttagattttcacatgaaggt

SEQ ID NO: 5133 - DNA, 21 bp, Homo sapiens
ggcatggatcctacctagaaa

SEQ ID NO: 5134 - DNA, 20 bp, Homo sapiens
gatagaggcaggtctctcct

SEQ ID NO: 5135 - DNA, 21 bp, Homo sapiens
agtccagcatggcaagaagct

SEQ ID NO: 5136 - DNA, 21 bp, Homo sapiens
ctcacattgacgctctccaac

SEQ ID NO: 5137 - DNA, 21 bp, Homo sapiens
catctcaggcgctctgccagc

SEQ ID NO: 5138 - DNA, 21 bp, Homo sapiens
catgcgcagagccctgagcag

SEQ ID NO: 5139 - DNA, 21 bp, Homo sapiens
aggtctcagcgtctctgcggt

SEQ ID NO: 5140 - DNA, 21 bp, Homo sapiens
ttggaagcccgtcaggaagaa

SEQ ID NO: 5141 - DNA, 21 bp, Homo sapiens
tgtgttgataatggacatgat

SEQ ID NO: 5142 - DNA, 21 bp, Homo sapiens
ggatgcccttgggagccacgg

SEQ ID NO: 5143 - DNA, 21 bp, Homo sapiens
gactccatctgggacactggg

SEQ ID NO: 5144 - DNA, 21 bp, Homo sapiens
ctaaagaaacatgtcttagtg

SEQ ID NO: 5145 - DNA, 21 bp, Homo sapiens
agcacgccacgtctgcagagg

SEQ ID NO: 5146 - DNA, 21 bp, Homo sapiens
cttgtgcccttttgcttgtct

SEQ ID NO: 5147 - DNA, 22 bp, Homo sapiens
caacggctcctgctcaggcctg

SEQ ID NO: 5148 - DNA, 21 bp, Homo sapiens
cttgcttctcgcctccatcac

SEQ ID NO: 5149 - DNA, 21 bp, Homo sapiens
tgtcaccttccatgtttcgtg

SEQ ID NO: 5150 - DNA, 23 bp, Homo sapiens
tgtggcacccattcccagccact

SEQ ID NO: 5151 - DNA, 21 bp, Homo sapiens
cgtcggcaggcgctgtgggtc

SEQ ID NO: 5152 - DNA, 21 bp, Homo sapiens
ctgaagctctcaataacctgc

SEQ ID NO: 5153 - DNA, 20 bp, Homo sapiens
attagtggataggctgacac

SEQ ID NO: 5154 - DNA, 21 bp, Homo sapiens
ccttcttggcgttgacacctg

SEQ ID NO: 5155 - DNA, 21 bp, Homo sapiens
gcagaaatggcgagaataccg

SEQ ID NO: 5156 - DNA, 21 bp, Homo sapiens
tggcgtggcgcgccccaggtg

SEQ ID NO: 5157 - DNA, 23 bp, Homo sapiens
cttatggctagtcagatgccaaa

SEQ ID NO: 5158 - DNA, 21 bp, Homo sapiens
actcggccagcagctcaccaa

SEQ ID NO: 5159 - DNA, 23 bp, Homo sapiens
ctgagcagcctggcctgccatgt

SEQ ID NO: 5160 - DNA, 21 bp, Homo sapiens
acatttgaaaacaactccata

SEQ ID NO: 5161 - DNA, 21 bp, Homo sapiens
tggctatcaagacttggtaac

SEQ ID NO: 5162 - DNA, 21 bp, Homo sapiens
tctgatccacagactggctca

SEQ ID NO: 5163 - DNA, 21 bp, Homo sapiens
gctgcctgagatgatgacaga

SEQ ID NO: 5164 - DNA, 21 bp, Homo sapiens
aaagtcagaaataattcctga

SEQ ID NO: 5165 - DNA, 21 bp, Homo sapiens
aagaaagggaaggagaaagac

SEQ ID NO: 5166 - DNA, 21 bp, Homo sapiens
cggtcactgcccacacccttg

SEQ ID NO: 5167 - DNA, 20 bp, Homo sapiens
tttaatggctgccgctctgg

SEQ ID NO: 5168 - DNA, 21 bp, Homo sapiens
cacgctctggcgcagggccag

SEQ ID NO: 5169 - DNA, 21 bp, Homo sapiens
cttacccttttcaggtaactc

SEQ ID NO: 5170 - DNA, 21 bp, Homo sapiens
actgctccaacgcagatctgg

SEQ ID NO: 5171 - DNA, 21 bp, Homo sapiens
ttggtgtcctcgtcaaagatc

SEQ ID NO: 5172 - DNA, 21 bp, Homo sapiens
ccacagacttctccaaatgtt

SEQ ID NO: 5173 - DNA, 21 bp, Homo sapiens
caacctcttcctgtggactgt

SEQ ID NO: 5174 - DNA, 21 bp, Homo sapiens
ccagttgacacggatatagcg

SEQ ID NO: 5175 - DNA, 21 bp, Homo sapiens
caggcccggcgccaaagacgt

SEQ ID NO: 5176 - DNA, 21 bp, Homo sapiens
ttgtcccgcaggatgtgggct

SEQ ID NO: 5177 - DNA, 21 bp, Homo sapiens
ggtccgggtcgttgttgatgc

SEQ ID NO: 5178 - DNA, 22 bp, Homo sapiens
caacggctcctgctcaggcctg

SEQ ID NO: 5179 - DNA, 22 bp, Homo sapiens
acagcagctctaccgccatggc

SEQ ID NO: 5180 - DNA, 21 bp, Homo sapiens
cctgcagcacctacaaagggg

SEQ ID NO: 5181 - DNA, 21 bp, Homo sapiens
agcatggagcgcgctgccgcc

SEQ ID NO: 5182 - DNA, 21 bp, Homo sapiens
agacaccatggaagggcatgc

SEQ ID NO: 5183 - DNA, 21 bp, Homo sapiens
tagcagcctccgagatgaggg

SEQ ID NO: 5184 - DNA, 21 bp, Homo sapiens
acgaggagcggaggcggcagc

SEQ ID NO: 5185 - DNA, 23 bp, Homo sapiens
gcgcttgcgctcgtcgctgcgcg

SEQ ID NO: 5186 - DNA, 21 bp, Homo sapiens
cctggccgcacgccagctgcc

SEQ ID NO: 5187 - DNA, 23 bp, Homo sapiens
gactggctggtttgataaccttc

SEQ ID NO: 5188 - DNA, 22 bp, Homo sapiens
agtggctgggcaggcagtgccc

SEQ ID NO: 5189 - DNA, 20 bp, Homo sapiens
gaagagaggcgggtcaaaga

SEQ ID NO: 5190 - DNA, 21 bp, Homo sapiens
ccgtgtagccgcaatcctcgc

SEQ ID NO: 5191 - DNA, 21 bp, Homo sapiens
cccgtggctgcgctggtggtg

SEQ ID NO: 5192 - DNA, 21 bp, Homo sapiens
caaagtcactgggccctgaga

SEQ ID NO: 5193 - DNA, 21 bp, Homo sapiens
caatctctgttcttggtaagt

SEQ ID NO: 5194 - DNA, 20 bp, Homo sapiens
ccgagtggctgccgcccatg

SEQ ID NO: 5195 - DNA, 22 bp, Homo sapiens
agacaggcttggttcgctcctc

SEQ ID NO: 5196 - DNA, 21 bp, Homo sapiens
ctcctccaccgaggcccgagt

SEQ ID NO: 5197 - DNA, 21 bp, Homo sapiens
tctggattcacgggaacgatg

SEQ ID NO: 5198 - DNA, 21 bp, Homo sapiens
tcctggttctcgtggtcttcc

SEQ ID NO: 5199 - DNA, 21 bp, Homo sapiens
aacgctctcaccgggagccag

SEQ ID NO: 5200 - DNA, 21 bp, Homo sapiens
gagggatttgcgccaaaagtg

SEQ ID NO: 5201 - DNA, 21 bp, Homo sapiens
tcttactcctatggaaccaat

SEQ ID NO: 5202 - DNA, 21 bp, Homo sapiens
cacctctccccagctccttgg

SEQ ID NO: 5203 - DNA, 21 bp, Homo sapiens
cctggtgtttgagcggtggga

SEQ ID NO: 5204 - DNA, 21 bp, Homo sapiens
gtccacttatcaaagccaggg

SEQ ID NO: 5205 - DNA, 21 bp, Homo sapiens
agaacacccccgctggatgaa

SEQ ID NO: 5206 - DNA, 21 bp, Homo sapiens
ttcagaatccaggcagcaagc

SEQ ID NO: 5207 - DNA, 21 bp, Homo sapiens
cctcctcgtcgtcctcctcct

SEQ ID NO: 5208 - DNA, 21 bp, Homo sapiens
tgtgtaatgccgaaggttctc

SEQ ID NO: 5209 - DNA, 21 bp, Homo sapiens
tccatccctacgacatttgca

SEQ ID NO: 5210 - DNA, 21 bp, Homo sapiens
aaattagcaaggtatgtaaaa

SEQ ID NO: 5211 - DNA, 21 bp, Homo sapiens
gagcaggactccctcctgcag

SEQ ID NO: 5212 - DNA, 21 bp, Homo sapiens
gaggagcaccgccgccagcca

SEQ ID NO: 5213 - DNA, 21 bp, Homo sapiens
atatggctggagactggcact

SEQ ID NO: 5214 - DNA, 21 bp, Homo sapiens
tgaacagcaccgctctcggag

SEQ ID NO: 5215 - DNA, 21 bp, Homo sapiens
gtccgacctccgtctgttcct

SEQ ID NO: 5216 - DNA, 21 bp, Homo sapiens
tgagacatgacgggccaatat

SEQ ID NO: 5217 - DNA, 21 bp, Homo sapiens
cgatggtccagttacctgttg

SEQ ID NO: 5218 - DNA, 21 bp, Homo sapiens
tctcagagccggcgtccccat

SEQ ID NO: 5219 - DNA, 21 bp, Homo sapiens
cttccagtggcgacggaacga

SEQ ID NO: 5220 - DNA, 21 bp, Homo sapiens
tgggggtaacgttggaggaga

SEQ ID NO: 5221 - DNA, 21 bp, Homo sapiens
cagacacttattcctcagctg

SEQ ID NO: 5222 - DNA, 22 bp, Homo sapiens
aaagccgaccacaacagccact

SEQ ID NO: 5223 - DNA, 21 bp, Homo sapiens
aaagaactcaataaacaaaaa

SEQ ID NO: 5224 - DNA, 21 bp, Homo sapiens
cacatttcacaggggtgagcc

SEQ ID NO: 5225 - DNA, 21 bp, Homo sapiens
gactggcaggagatcaccttt

SEQ ID NO: 5226 - DNA, 21 bp, Homo sapiens
ggaggtctgtcctcccgaacc

SEQ ID NO: 5227 - DNA, 21 bp, Homo sapiens
tggaaagaagacttgtgaatc

SEQ ID NO: 5228 - DNA, 21 bp, Homo sapiens
tctatgggctaatgaagctgg

SEQ ID NO: 5229 - DNA, 21 bp, Homo sapiens
caagggcaacttccagaccat

SEQ ID NO: 5230 - DNA, 21 bp, Homo sapiens
agttggatcatggccgcttaa

SEQ ID NO: 5231 - DNA, 21 bp, Homo sapiens
ggatcatggccgcttaagatt

SEQ ID NO: 5232 - DNA, 23 bp, Homo sapiens
ggttactgcctcacctgccaatg

SEQ ID NO: 5233 - DNA, 21 bp, Homo sapiens
cagggcttgaccgatggctgg

SEQ ID NO: 5234 - DNA, 22 bp, Homo sapiens
tcctggttggacgagccgttga

SEQ ID NO: 5235 - DNA, 21 bp, Homo sapiens
ttactgtagacggattttgaa

SEQ ID NO: 5236 - DNA, 21 bp, Homo sapiens
caccgcaactgtctgtctcat

SEQ ID NO: 5237 - DNA, 21 bp, Homo sapiens
gtttttggaagaaaccagcct

SEQ ID NO: 5238 - DNA, 21 bp, Homo sapiens
cagaggaggagcaggtagtcc

SEQ ID NO: 5239 - DNA, 21 bp, Homo sapiens
atagctgctcttctgcactga

SEQ ID NO: 5240 - DNA, 21 bp, Homo sapiens
accccaactacgaaatcatgc

SEQ ID NO: 5241 - DNA, 21 bp, Homo sapiens
actgttcctgcgggtgaggga

SEQ ID NO: 5242 - DNA, 20 bp, Homo sapiens
cagattggctgttacagacc

SEQ ID NO: 5243 - DNA, 21 bp, Homo sapiens
cacagtctaccctctggtagg

SEQ ID NO: 5244 - DNA, 21 bp, Homo sapiens
tccaggatctcgaggcccacc

SEQ ID NO: 5245 - DNA, 21 bp, Homo sapiens
tacgcatttacggctttgtcc

SEQ ID NO: 5246 - DNA, 21 bp, Homo sapiens
tacacccagtcgaagccggcc

SEQ ID NO: 5247 - DNA, 21 bp, Homo sapiens
agctgcaagtccttgaggatg

SEQ ID NO: 5248 - DNA, 21 bp, Homo sapiens
tcttcctccgggaaaacatcc

SEQ ID NO: 5249 - DNA, 21 bp, Homo sapiens
gaggcgctgcgtggctgcggc

SEQ ID NO: 5250 - DNA, 23 bp, Homo sapiens
tacggcagccacaccagcctgca

SEQ ID NO: 5251 - DNA, 21 bp, Homo sapiens
cactgtgatcgtgtggcctcg

SEQ ID NO: 5252 - DNA, 21 bp, Homo sapiens
gcgtttcctggcacgttgacg

SEQ ID NO: 5253 - DNA, 20 bp, Homo sapiens
attagtggataggctgacac

SEQ ID NO: 5254 - DNA, 22 bp, Homo sapiens
ggctggggggctggtggcgcca

SEQ ID NO: 5255 - DNA, 21 bp, Homo sapiens
gcagcctgcgcgggggatgtc

SEQ ID NO: 5256 - DNA, 21 bp, Homo sapiens
ttacggaaccggagaacaatg

SEQ ID NO: 5257 - DNA, 21 bp, Homo sapiens
tgcattaacaagtatacctgt

SEQ ID NO: 5258 - DNA, 21 bp, Homo sapiens
cgacaccgtccgggtgaaaaa

SEQ ID NO: 5259 - DNA, 21 bp, Homo sapiens
gaaggtttgaagttccttttt

SEQ ID NO: 5260 - DNA, 21 bp, Homo sapiens
aagctgttggcggagatctcc

SEQ ID NO: 5261 - DNA, 21 bp, Homo sapiens
aattgcccttgtggatgattc

SEQ ID NO: 5262 - DNA, 21 bp, Homo sapiens
gatggtgaggatggtgagcgt

SEQ ID NO: 5263 - DNA, 21 bp, Homo sapiens
ggaaagaacggggttccaaaa

SEQ ID NO: 5264 - DNA, 21 bp, Homo sapiens
ttggacaccgagcctgctgcc

SEQ ID NO: 5265 - DNA, 21 bp, Homo sapiens
tattggctggtgcaacaacat

SEQ ID NO: 5266 - DNA, 22 bp, Homo sapiens
cagagacctcgtccgccgctgc

SEQ ID NO: 5267 - DNA, 21 bp, Homo sapiens
ttagggtgttgttgctgatac

SEQ ID NO: 5268 - DNA, 21 bp, Homo sapiens
gtggtcgcccgccagcacgag

SEQ ID NO: 5269 - DNA, 21 bp, Homo sapiens
tatcatcctcgcctggctcaa

SEQ ID NO: 5270 - DNA, 21 bp, Homo sapiens
gcgtgatggcgttgcgttgca

SEQ ID NO: 5271 - DNA, 21 bp, Homo sapiens
aatctcaatagattaatatct

SEQ ID NO: 5272 - DNA, 21 bp, Homo sapiens
atagagcgaagtaagtatgtg

SEQ ID NO: 5273 - DNA, 23 bp, Homo sapiens
aacgttgtcaatgaagccacaac

SEQ ID NO: 5274 - DNA, 21 bp, Homo sapiens
gccgatgcttcagagcagaca

SEQ ID NO: 5275 - DNA, 21 bp, Homo sapiens
gtggatattcgtcaaggtgct

SEQ ID NO: 5276 - DNA, 21 bp, Homo sapiens
tcggtggtagcggtcgctgag

SEQ ID NO: 5277 - DNA, 21 bp, Homo sapiens
ctcttccggacgcaggtctgt

SEQ ID NO: 5278 - DNA, 21 bp, Homo sapiens
cagtgggccattgagggaatc

SEQ ID NO: 5279 - DNA, 21 bp, Homo sapiens
tgccgttcagcctccagctct

SEQ ID NO: 5280 - DNA, 21 bp, Homo sapiens
acacgctgacggaggagctag

SEQ ID NO: 5281 - DNA, 21 bp, Homo sapiens
acagagtatagtacctacaat

SEQ ID NO: 5282 - DNA, 21 bp, Homo sapiens
aaagcctgaacgaccgcctgg

SEQ ID NO: 5283 - DNA, 21 bp, Homo sapiens
agcagctcttgaccatgaaag

SEQ ID NO: 5284 - DNA, 22 bp, Homo sapiens
agaaatcagctactcctgccaa

SEQ ID NO: 5285 - DNA, 21 bp, Homo sapiens
gcccaggcggtcagcgttgga

SEQ ID NO: 5286 - DNA, 21 bp, Homo sapiens
gcggtggtaaacccacggacc

SEQ ID NO: 5287 - DNA, 21 bp, Homo sapiens
cctctctctgaaatcactgag

SEQ ID NO: 5288 - DNA, 21 bp, Homo sapiens
ttcaccctacgtggtggccag

SEQ ID NO: 5289 - DNA, 21 bp, Homo sapiens
tccgggcagctccatccgtgt

SEQ ID NO: 5290 - DNA, 21 bp, Homo sapiens
cgctatgatggagtccacttc

SEQ ID NO: 5291 - DNA, 21 bp, Homo sapiens
acaccgaaagcgggtctgact

SEQ ID NO: 5292 - DNA, 21 bp, Homo sapiens
atgaccgctacgtggccatct

SEQ ID NO: 5293 - DNA, 21 bp, Homo sapiens
atcttgcttacgagggccaca

SEQ ID NO: 5294 - DNA, 21 bp, Homo sapiens
tcggcctggcgccgctcacca

SEQ ID NO: 5295 - DNA, 23 bp, Homo sapiens
cagcggcgggaacgatagctgca

SEQ ID NO: 5296 - DNA, 21 bp, Homo sapiens
agattcagggggccaaggcgc

SEQ ID NO: 5297 - DNA, 21 bp, Homo sapiens
ctcgtggaagaggagctcagg

SEQ ID NO: 5298 - DNA, 21 bp, Homo sapiens
caaacatgtcgaacgggagca

SEQ ID NO: 5299 - DNA, 21 bp, Homo sapiens
tccataggtcccagggcaatg

SEQ ID NO: 5300 - DNA, 22 bp, Homo sapiens
acaatggcggtcgctcgtgcag

SEQ ID NO: 5301 - DNA, 21 bp, Homo sapiens
agctgcagtttcctcatgtgc

SEQ ID NO: 5302 - DNA, 21 bp, Homo sapiens
ctccagctgcgtgtagaggaa

SEQ ID NO: 5303 - DNA, 21 bp, Homo sapiens
tgcccgaatacaccaatctct

SEQ ID NO: 5304 - DNA, 21 bp, Homo sapiens
ataagcatgacgacctatgat

SEQ ID NO: 5305 - DNA, 21 bp, Homo sapiens
cggctggggcccctatgccat

SEQ ID NO: 5306 - DNA, 21 bp, Homo sapiens
tgtgtgctcccttgaggccga

SEQ ID NO: 5307 - DNA, 21 bp, Homo sapiens
aactgttgagtgctctggtga

SEQ ID NO: 5308 - DNA, 21 bp, Homo sapiens
tggccatgtcgatcattgcca

SEQ ID NO: 5309 - DNA, 21 bp, Homo sapiens
ccgccaacaggacaggtgccc

SEQ ID NO: 5310 - DNA, 21 bp, Homo sapiens
agagctccccggaggagcagc

SEQ ID NO: 5311 - DNA, 22 bp, Homo sapiens
cttgcggcggccgagctccaag

SEQ ID NO: 5312 - DNA, 21 bp, Homo sapiens
atcatttcgatcatccagggc

SEQ ID NO: 5313 - DNA, 21 bp, Homo sapiens
gcacaccaccgtttctgccat

SEQ ID NO: 5314 - DNA, 21 bp, Homo sapiens
gtctgatatgaagcactccgt

SEQ ID NO: 5315 - DNA, 21 bp, Homo sapiens
cagggggagaagctttctctg

SEQ ID NO: 5316 - DNA, 21 bp, Homo sapiens
ttgactgtgagagattattga

SEQ ID NO: 5317 - DNA, 21 bp, Homo sapiens
ggcaaaatctggcccacaagt

SEQ ID NO: 5318 - DNA, 21 bp, Homo sapiens
ccatccagtcgctgacctggg

SEQ ID NO: 5319 - DNA, 21 bp, Homo sapiens
agcttcttttcgggattggca

SEQ ID NO: 5320 - DNA, 21 bp, Homo sapiens
acggctttctggctgccgaac

SEQ ID NO: 5321 - DNA, 21 bp, Homo sapiens
agaactagccaatacttttga

SEQ ID NO: 5322 - DNA, 21 bp, Homo sapiens
tgagtgccgcacttcagacac

SEQ ID NO: 5323 - DNA, 22 bp, Homo sapiens
actggctgttgtggcaggttcc

SEQ ID NO: 5324 - DNA, 21 bp, Homo sapiens
gtgccgtgctccaggtggcca

SEQ ID NO: 5325 - DNA, 21 bp, Homo sapiens
tgaaacatgacggcatccgaa

SEQ ID NO: 5326 - DNA, 21 bp, Homo sapiens
gacagcgtgattctgattaaa

SEQ ID NO: 5327 - DNA, 21 bp, Homo sapiens
tctctgtttctgagtgacaaa

SEQ ID NO: 5328 - DNA, 21 bp, Homo sapiens
ctggacagggcgccggattta

SEQ ID NO: 5329 - DNA, 21 bp, Homo sapiens
aatggagcccttaccagaccc

SEQ ID NO: 5330 - DNA, 21 bp, Homo sapiens
tttctgcagattgacttgcac

SEQ ID NO: 5331 - DNA, 21 bp, Homo sapiens
catgccgctgctgctactgct

SEQ ID NO: 5332 - DNA, 21 bp, Homo sapiens
aacagcaccgtgactttctca

SEQ ID NO: 5333 - DNA, 21 bp, Homo sapiens
tggtggtgaggaccatcagag

SEQ ID NO: 5334 - DNA, 21 bp, Homo sapiens
tttacgctgacatccctgtgc

SEQ ID NO: 5335 - DNA, 21 bp, Homo sapiens
aggacccttccacgggctgct

SEQ ID NO: 5336 - DNA, 21 bp, Homo sapiens
ccagtaagaccctattaaaaa

SEQ ID NO: 5337 - DNA, 21 bp, Homo sapiens
cacttctcctgctccccttca

SEQ ID NO: 5338 - DNA, 21 bp, Homo sapiens
cacccggggcccgtcagccgc

SEQ ID NO: 5339 - DNA, 21 bp, Homo sapiens
ccagaagtttcccctcctaac

SEQ ID NO: 5340 - DNA, 21 bp, Homo sapiens
agcctccagatttcccagttc

SEQ ID NO: 5341 - DNA, 21 bp, Homo sapiens
tttcttctgcgaaatcccacc

SEQ ID NO: 5342 - DNA, 21 bp, Homo sapiens
tcatcaaaatccacctggcca

SEQ ID NO: 5343 - DNA, 21 bp, Homo sapiens
ttgaggacccgggtgatgtcc

SEQ ID NO: 5344 - DNA, 21 bp, Homo sapiens
tattgcagcacacgtcacatg

SEQ ID NO: 5345 - DNA, 21 bp, Homo sapiens
cggaccaccctgctggccggt

SEQ ID NO: 5346 - DNA, 21 bp, Homo sapiens
tgtggcttgagtcctctcccc

SEQ ID NO: 5347 - DNA, 21 bp, Homo sapiens
cgctatatccagaatcggttg

SEQ ID NO: 5348 - DNA, 21 bp, Homo sapiens
atgttgggcaggctgaccacc

SEQ ID NO: 5349 - DNA, 21 bp, Homo sapiens
tgttgggcaggctgaccacct

SEQ ID NO: 5350 - DNA, 21 bp, Homo sapiens
atggccctgcgcaaccacgtg

SEQ ID NO: 5351 - DNA, 21 bp, Homo sapiens
catggccctgcgcaaccacgt

SEQ ID NO: 5352 - DNA, 21 bp, Homo sapiens
ccctgcaccgggaaccagcag

SEQ ID NO: 5353 - DNA, 21 bp, Homo sapiens
agcccagttcggaatggttag

SEQ ID NO: 5354 - DNA, 21 bp, Homo sapiens
cttggttttagcttctgtaat

SEQ ID NO: 5355 - DNA, 21 bp, Homo sapiens
acgtttgctgcaacagatggt

SEQ ID NO: 5356 - DNA, 21 bp, Homo sapiens
gtggatattcgtcaaggtgct

SEQ ID NO: 5357 - DNA, 21 bp, Homo sapiens
cagcactctgtaagtccttct

SEQ ID NO: 5358 - DNA, 21 bp, Homo sapiens
tgaaaataggtactttgtttt

SEQ ID NO: 5359 - DNA, 21 bp, Homo sapiens
ttttttttttagccaaaagtc

SEQ ID NO: 5360 - DNA, 21 bp, Homo sapiens
tgccactggcgtcgggcctcc

SEQ ID NO: 5361 - DNA, 21 bp, Homo sapiens
catgcttgctgtatactatga

SEQ ID NO: 5362 - DNA, 21 bp, Homo sapiens
atgatggttgccctctttact

SEQ ID NO: 5363 - DNA, 21 bp, Homo sapiens
aagtccaagtatctctggcga

SEQ ID NO: 5364 - DNA, 21 bp, Homo sapiens
gaatgaccagcaatggtgttg

SEQ ID NO: 5365 - DNA, 21 bp, Homo sapiens
acacgaatggttgatatacct

SEQ ID NO: 5366 - DNA, 21 bp, Homo sapiens
cagatctccaactatgtggca

SEQ ID NO: 5367 - DNA, 21 bp, Homo sapiens
ttgcaaggctgctcgccgaag

SEQ ID NO: 5368 - DNA, 21 bp, Homo sapiens
ccaatgggagctgctggggtg

SEQ ID NO: 5369 - DNA, 23 bp, Homo sapiens
gatgtggctcgagccattaacca

SEQ ID NO: 5370 - DNA, 20 bp, Homo sapiens
tccagcggctcgggcttgca

SEQ ID NO: 5371 - DNA, 21 bp, Homo sapiens
ccgaagcagccgcggggctcc

SEQ ID NO: 5372 - DNA, 21 bp, Homo sapiens
agccccttggtgcacagctcc

SEQ ID NO: 5373 - DNA, 21 bp, Homo sapiens
tcttctgtgtggcagtcttct

SEQ ID NO: 5374 - DNA, 21 bp, Homo sapiens
cttctgtgtggcagtcttctc

SEQ ID NO: 5375 - DNA, 21 bp, Homo sapiens
cagcagagtgtaggtcagaag

SEQ ID NO: 5376 - DNA, 21 bp, Homo sapiens
ctgccttttgagattaactag

SEQ ID NO: 5377 - DNA, 21 bp, Homo sapiens
caacgacgagaagaagatgtt

SEQ ID NO: 5378 - DNA, 21 bp, Homo sapiens
atgttggacacggcggggagg

SEQ ID NO: 5379 - DNA, 21 bp, Homo sapiens
ccattcctggggctctgggcc

SEQ ID NO: 5380 - DNA, 21 bp, Homo sapiens
agtgcactgagatgcccccac

SEQ ID NO: 5381 - DNA, 21 bp, Homo sapiens
ttttctccgaggatttcatct

SEQ ID NO: 5382 - DNA, 21 bp, Homo sapiens
catttgagacggagttggctt

SEQ ID NO: 5383 - DNA, 21 bp, Homo sapiens
ttttcctggtcactacaaagt

SEQ ID NO: 5384 - DNA, 21 bp, Homo sapiens
gcgagctgaggacttactttg

SEQ ID NO: 5385 - DNA, 21 bp, Homo sapiens
ggaagaagcctttggctttgc

SEQ ID NO: 5386 - DNA, 21 bp, Homo sapiens
cgctgtaagacgggaggatct

SEQ ID NO: 5387 - DNA, 21 bp, Homo sapiens
tggtctctccggggccgaatc

SEQ ID NO: 5388 - DNA, 21 bp, Homo sapiens
aaattggatttcgaaaaaatt

SEQ ID NO: 5389 - DNA, 21 bp, Homo sapiens
ttacctttagattaggagtga

SEQ ID NO: 5390 - DNA, 21 bp, Homo sapiens
tcaggaggtcatgtttgtgct

SEQ ID NO: 5391 - DNA, 21 bp, Homo sapiens
ctccagaggaaagagtagtac

SEQ ID NO: 5392 - DNA, 21 bp, Homo sapiens
gtcaggaggtcatgtttgtgc

SEQ ID NO: 5393 - DNA, 21 bp, Homo sapiens
gtggcagacctgcagaaggaa

SEQ ID NO: 5394 - DNA, 21 bp, Homo sapiens
aaccaaaaaagaatccagtga

SEQ ID NO: 5395 - DNA, 21 bp, Homo sapiens
caatatcacccgaagctttct

SEQ ID NO: 5396 - DNA, 21 bp, Homo sapiens
cacaagtgccgccatgacagg

SEQ ID NO: 5397 - DNA, 21 bp, Homo sapiens
cttgtatatccggaattcagc

SEQ ID NO: 5398 - DNA, 21 bp, Homo sapiens
accaatacttgatgtaagtat

SEQ ID NO: 5399 - DNA, 21 bp, Homo sapiens
gtcctatttgcgggttctgcg

SEQ ID NO: 5400 - DNA, 21 bp, Homo sapiens
ggatggaaaccccttaagcaa

SEQ ID NO: 5401 - DNA, 23 bp, Homo sapiens
gcagcagcaacagcagcagcagc

SEQ ID NO: 5402 - DNA, 21 bp, Homo sapiens
atgtgatacccgataataagc

SEQ ID NO: 5403 - DNA, 21 bp, Homo sapiens
ctgatagggaatcccttctac

SEQ ID NO: 5404 - DNA, 21 bp, Homo sapiens
tccttcagaaacaccctggag

SEQ ID NO: 5405 - DNA, 21 bp, Homo sapiens
ccggtatacaatggtgagaca

SEQ ID NO: 5406 - DNA, 21 bp, Homo sapiens
cgtgaagaaaagatcctcaat

SEQ ID NO: 5407 - DNA, 21 bp, Homo sapiens
tccaaatctgcgagtaaaaaa

SEQ ID NO: 5408 - DNA, 21 bp, Homo sapiens
cgctcagggggctctggaaag

SEQ ID NO: 5409 - DNA, 21 bp, Homo sapiens
ccagggggccgcggggggagc

SEQ ID NO: 5410 - DNA, 21 bp, Homo sapiens
agaggagggtggaaatgaagg

SEQ ID NO: 5411 - DNA, 21 bp, Homo sapiens
ccggggcgcaggcgcccgtgc

SEQ ID NO: 5412 - DNA, 20 bp, Homo sapiens
aatgccggctcgggggcctt

SEQ ID NO: 5413 - DNA, 21 bp, Homo sapiens
catggacataacagggctcga

SEQ ID NO: 5414 - DNA, 22 bp, Homo sapiens
caacggctcctgctcaggcctg

SEQ ID NO: 5415 - DNA, 21 bp, Homo sapiens
ccttacctgggagacataagg

SEQ ID NO: 5416 - DNA, 23 bp, Homo sapiens
actaagatgctgtcccagccgta

SEQ ID NO: 5417 - DNA, 21 bp, Homo sapiens
tgattgcacacgacgtggatc

SEQ ID NO: 5418 - DNA, 21 bp, Homo sapiens
agttctttacgtattgtcacc

SEQ ID NO: 5419 - DNA, 23 bp, Homo sapiens
cccagtgaactcacctgccgatt

SEQ ID NO: 5420 - DNA, 21 bp, Homo sapiens
ctctccgcgggagccctcttc

SEQ ID NO: 5421 - DNA, 20 bp, Homo sapiens
ttggtgtggcttgggcacct

SEQ ID NO: 5422 - DNA, 21 bp, Homo sapiens
ctcgctctccgtcagcgtgtt

SEQ ID NO: 5423 - DNA, 22 bp, Homo sapiens
atgtggcaggccgcctgcccat

SEQ ID NO: 5424 - DNA, 21 bp, Homo sapiens
tgtccgtattcaaattggcct

SEQ ID NO: 5425 - DNA, 21 bp, Homo sapiens
ctccccaggacggactggagc

SEQ ID NO: 5426 - DNA, 21 bp, Homo sapiens
gtttggaatgtcaagtgattg

SEQ ID NO: 5427 - DNA, 20 bp, Homo sapiens
aatgccggctcgggggcctt

SEQ ID NO: 5428 - DNA, 21 bp, Homo sapiens
accaggaaacgaaaacctaag

SEQ ID NO: 5429 - DNA, 21 bp, Homo sapiens
acatgcctcaccagatggacg

SEQ ID NO: 5430 - DNA, 20 bp, Homo sapiens
acttgtggcagctttggatg

SEQ ID NO: 5431 - DNA, 21 bp, Homo sapiens
ataagtttttcgtaacagaca

SEQ ID NO: 5432 - DNA, 21 bp, Homo sapiens
ggatcttcacgctgaagacat

SEQ ID NO: 5433 - DNA, 21 bp, Homo sapiens
ctcaaggaagcccagctccct

SEQ ID NO: 5434 - DNA, 21 bp, Homo sapiens
gcggcaggggtacttcctccg

SEQ ID NO: 5435 - DNA, 22 bp, Homo sapiens
atagtggccgttgtctcagagg

SEQ ID NO: 5436 - DNA, 21 bp, Homo sapiens
gttggactggcgccaggaccc

SEQ ID NO: 5437 - DNA, 21 bp, Homo sapiens
ctgtgtactcggtaaatgtac

SEQ ID NO: 5438 - DNA, 21 bp, Homo sapiens
ttgctttcctttgtttatctc

SEQ ID NO: 5439 - DNA, 21 bp, Homo sapiens
taaaggatgagaaataaaaga

SEQ ID NO: 5440 - DNA, 21 bp, Homo sapiens
ggtgtgcctacgtggtgaccc

SEQ ID NO: 5441 - DNA, 21 bp, Homo sapiens
gataagggccgaaaatacaaa

SEQ ID NO: 5442 - DNA, 21 bp, Homo sapiens
ctcaacggaggcagcccagag

SEQ ID NO: 5443 - DNA, 21 bp, Homo sapiens
ccttcgacccggcagcagccg

SEQ ID NO: 5444 - DNA, 21 bp, Homo sapiens
tgtgaccatgttaagacagat

SEQ ID NO: 5445 - DNA, 21 bp, Homo sapiens
agaactcttcgccctcgaaca

SEQ ID NO: 5446 - DNA, 21 bp, Homo sapiens
cagtggcaggcggggagaccg

SEQ ID NO: 5447 - DNA, 21 bp, Homo sapiens
acagctgagcgtcgttcccct

SEQ ID NO: 5448 - DNA, 21 bp, Homo sapiens
cacctcattccctagagatgt

SEQ ID NO: 5449 - DNA, 22 bp, Homo sapiens
gctgcggcggctgcttccgcac

SEQ ID NO: 5450 - DNA, 21 bp, Homo sapiens
tcctccatttcgctgtcgtca

SEQ ID NO: 5451 - DNA, 21 bp, Homo sapiens
ttctgagctcggcaggtgaat

SEQ ID NO: 5452 - DNA, 21 bp, Homo sapiens
cggttgttgtccatggacagg

SEQ ID NO: 5453 - DNA, 21 bp, Homo sapiens
tgctgtcttccgctggggaga

SEQ ID NO: 5454 - DNA, 21 bp, Homo sapiens
ttgtcagcaacgatggcatca

SEQ ID NO: 5455 - DNA, 21 bp, Homo sapiens
cccccaggtcgcgatggtcaa

SEQ ID NO: 5456 - DNA, 21 bp, Homo sapiens
ctaaagaaacatgtcttagtg

SEQ ID NO: 5457 - DNA, 21 bp, Homo sapiens
tcctggttcacccagaattga

SEQ ID NO: 5458 - DNA, 22 bp, Homo sapiens
tggctggcggctgtgggcgatg

SEQ ID NO: 5459 - DNA, 21 bp, Homo sapiens
aaagtaatttcttctattgta

SEQ ID NO: 5460 - DNA, 22 bp, Homo sapiens
cagcggctggcagcccctctgc

SEQ ID NO: 5461 - DNA, 21 bp, Homo sapiens
gattgcagaggagtctcagct

SEQ ID NO: 5462 - DNA, 21 bp, Homo sapiens
agtctttggattggtggttag

SEQ ID NO: 5463 - DNA, 21 bp, Homo sapiens
atctgatttgctgctgaagcg

SEQ ID NO: 5464 - DNA, 22 bp, Homo sapiens
ggagaagcgcgacagccgcaac

SEQ ID NO: 5465 - DNA, 21 bp, Homo sapiens
actaactagacggtggatgtg

SEQ ID NO: 5466 - DNA, 21 bp, Homo sapiens
ctttataaaacttgcaagttg

SEQ ID NO: 5467 - DNA, 21 bp, Homo sapiens
tgtgttgataatggacatgat

SEQ ID NO: 5468 - DNA, 21 bp, Homo sapiens
tcttggaacccgaggggctgg

SEQ ID NO: 5469 - DNA, 21 bp, Homo sapiens
caaacacacccgcaggcagct

SEQ ID NO: 5470 - DNA, 21 bp, Homo sapiens
gcttcgagaggataatgcaga

SEQ ID NO: 5471 - DNA, 21 bp, Homo sapiens
tgtcttagtggccaaaattgt

SEQ ID NO: 5472 - DNA, 21 bp, Homo sapiens
ctggacgacgcgcttgggatg

SEQ ID NO: 5473 - DNA, 21 bp, Homo sapiens
gggggtccacgaagataaagc

SEQ ID NO: 5474 - DNA, 21 bp, Homo sapiens
ggaacatgcccttcttggtct

SEQ ID NO: 5475 - DNA, 21 bp, Homo sapiens
gagcagcaccgtcccagccag

SEQ ID NO: 5476 - DNA, 21 bp, Homo sapiens
cacccccatccccatgatgcc

SEQ ID NO: 5477 - DNA, 20 bp, Homo sapiens
tgtagtggcagcccagtgct

SEQ ID NO: 5478 - DNA, 21 bp, Homo sapiens
cgaggccgccgagtaccagga

SEQ ID NO: 5479 - DNA, 20 bp, Homo sapiens
tggagtggcagctttgtctt

SEQ ID NO: 5480 - DNA, 21 bp, Homo sapiens
agcttggccggccctgatcca

SEQ ID NO: 5481 - DNA, 23 bp, Homo sapiens
gatgagttccagaccgccaatgc

SEQ ID NO: 5482 - DNA, 21 bp, Homo sapiens
ggtgtgccacggaccacaatg

SEQ ID NO: 5483 - DNA, 21 bp, Homo sapiens
tggtggtggcggaagatggct

SEQ ID NO: 5484 - DNA, 21 bp, Homo sapiens
agcatttctgcgcctggtgag

SEQ ID NO: 5485 - DNA, 21 bp, Homo sapiens
gatccagaatgaaacccagga

SEQ ID NO: 5486 - DNA, 21 bp, Homo sapiens
gtatgcgagacgctgcagttc

SEQ ID NO: 5487 - DNA, 22 bp, Homo sapiens
gtgattgtcagcaagccacacc

SEQ ID NO: 5488 - DNA, 23 bp, Homo sapiens
tgcattggatttacctgccactg

SEQ ID NO: 5489 - DNA, 21 bp, Homo sapiens
atagagttttaggaagtcccg

SEQ ID NO: 5490 - DNA, 23 bp, Homo sapiens
ggcctttggcatgcagccactgg

SEQ ID NO: 5491 - DNA, 21 bp, Homo sapiens
gttagacatccagaaaagaat

SEQ ID NO: 5492 - DNA, 23 bp, Homo sapiens
cagtggcggggatggtggcagca

SEQ ID NO: 5493 - DNA, 21 bp, Homo sapiens
cgcctggagtcgggtttggcc

SEQ ID NO: 5494 - DNA, 21 bp, Homo sapiens
ggctggccgtgcggctggagt

SEQ ID NO: 5495 - DNA, 21 bp, Homo sapiens
aaccgtcccagaaagcaaagc

SEQ ID NO: 5496 - DNA, 23 bp, Homo sapiens
agtatatatcattccagccatag

SEQ ID NO: 5497 - DNA, 21 bp, Homo sapiens
gtgactgctcccgcctggtgg

SEQ ID NO: 5498 - DNA, 21 bp, Homo sapiens
cttttttggcgttaaatgatt

SEQ ID NO: 5499 - DNA, 21 bp, Homo sapiens
tatggactttcgaatatacct

SEQ ID NO: 5500 - DNA, 21 bp, Homo sapiens
tgcatcagatgacatcggctg

SEQ ID NO: 5501 - DNA, 21 bp, Homo sapiens
aaagtgggagggttatcattg

SEQ ID NO: 5502 - DNA, 21 bp, Homo sapiens
atccccttcaccttgagcaga

SEQ ID NO: 5503 - DNA, 21 bp, Homo sapiens
agggtgtcacctgaagtagct

SEQ ID NO: 5504 - DNA, 21 bp, Homo sapiens
agcagtcaagagatttatcat

SEQ ID NO: 5505 - DNA, 21 bp, Homo sapiens
gtccctcagcccagcaagcct

SEQ ID NO: 5506 - DNA, 21 bp, Homo sapiens
ctctccttgcagcctcacctg

SEQ ID NO: 5507 - DNA, 21 bp, Homo sapiens
tccaagtcacgacgtgtatgc

SEQ ID NO: 5508 - DNA, 21 bp, Homo sapiens
ttccagaaacgccttcacatc

SEQ ID NO: 5509 - DNA, 21 bp, Homo sapiens
tttttctttagtatgtctttt

SEQ ID NO: 5510 - DNA, 21 bp, Homo sapiens
tgggctatggcgttggattct

SEQ ID NO: 5511 - DNA, 22 bp, Homo sapiens
tcaccggcttgctgaccacaat

SEQ ID NO: 5512 - DNA, 21 bp, Homo sapiens
aggaagtcaaggaatgggatt

SEQ ID NO: 5513 - DNA, 21 bp, Homo sapiens
tggacaggcgcggagttggag

SEQ ID NO: 5514 - DNA, 21 bp, Homo sapiens
ccaaattacagccacttctta

SEQ ID NO: 5515 - DNA, 21 bp, Homo sapiens
caaaaggggcgtgtggcttct

SEQ ID NO: 5516 - DNA, 21 bp, Homo sapiens
tcttcttcttcgagtagaatg

SEQ ID NO: 5517 - DNA, 21 bp, Homo sapiens
cggctagcctatctccggcta

SEQ ID NO: 5518 - DNA, 22 bp, Homo sapiens
caccgtgctcttcccacagcca

SEQ ID NO: 5519 - DNA, 21 bp, Homo sapiens
caaagatggcaagtgagtatc

SEQ ID NO: 5520 - DNA, 22 bp, Homo sapiens
ggagcggcggctggagaagcag

SEQ ID NO: 5521 - DNA, 21 bp, Homo sapiens
gccttgctgacgaaaactgtg

SEQ ID NO: 5522 - DNA, 21 bp, Homo sapiens
gcgtttgcttcgattctgaaa

SEQ ID NO: 5523 - DNA, 21 bp, Homo sapiens
ccaaaaggcgcgacgcatgca

SEQ ID NO: 5524 - DNA, 21 bp, Homo sapiens
gctgggtgtcggccaatatct

SEQ ID NO: 5525 - DNA, 21 bp, Homo sapiens
ttccgtcaggatctgtatggt

SEQ ID NO: 5526 - DNA, 20 bp, Homo sapiens
ctttatggctaccacttcac

SEQ ID NO: 5527 - DNA, 20 bp, Homo sapiens
ggttgcggctgttgtccatg

SEQ ID NO: 5528 - DNA, 21 bp, Homo sapiens
ctgtgtctgcgccacttgtgg

SEQ ID NO: 5529 - DNA, 21 bp, Homo sapiens
tactccctaggactttatatc

SEQ ID NO: 5530 - DNA, 23 bp, Homo sapiens
acccaaatccttgccctgccaat

SEQ ID NO: 5531 - DNA, 21 bp, Homo sapiens
tcattttgtcgcctagcagct

SEQ ID NO: 5532 - DNA, 23 bp, Homo sapiens
aggaataggcaggcctgccattc

SEQ ID NO: 5533 - DNA, 20 bp, Homo sapiens
aagagtggctactttctatc

SEQ ID NO: 5534 - DNA, 20 bp, Homo sapiens
gaatattggcttgaaccttt

SEQ ID NO: 5535 - DNA, 21 bp, Homo sapiens
gcttcgtggaggttgccgttg

SEQ ID NO: 5536 - DNA, 21 bp, Homo sapiens
tcacacaactgctgggctaaa

SEQ ID NO: 5537 - DNA, 21 bp, Homo sapiens
aacctccacccccagcgcttc

SEQ ID NO: 5538 - DNA, 21 bp, Homo sapiens
acatccccaactttgtgaaca

SEQ ID NO: 5539 - DNA, 21 bp, Homo sapiens
taccacaaatgtttccaactc

SEQ ID NO: 5540 - DNA, 21 bp, Homo sapiens
gaatctagttccattttagac

SEQ ID NO: 5541 - DNA, 21 bp, Homo sapiens
cagacgccgcgtttccgagag

SEQ ID NO: 5542 - DNA, 21 bp, Homo sapiens
gcatggcccacggcgtcccgg

SEQ ID NO: 5543 - DNA, 21 bp, Homo sapiens
tccatgtgacgttggttggca

SEQ ID NO: 5544 - DNA, 21 bp, Homo sapiens
aagtatggaatgccaacatgg

SEQ ID NO: 5545 - DNA, 21 bp, Homo sapiens
agttaaagtccgagtcatgaa

SEQ ID NO: 5546 - DNA, 23 bp, Homo sapiens
tgaggctgtctgctgctgccacc

SEQ ID NO: 5547 - DNA, 21 bp, Homo sapiens
ctcacttggcatctttccatc

SEQ ID NO: 5548 - DNA, 22 bp, Homo sapiens
catgacaaagttggcgagccat

SEQ ID NO: 5549 - DNA, 21 bp, Homo sapiens
agaaagtcaggtaagtttaga

SEQ ID NO: 5550 - DNA, 21 bp, Homo sapiens
ttccagtaccacaggcagatc

SEQ ID NO: 5551 - DNA, 21 bp, Homo sapiens
catagttggcgtcatctgcat

SEQ ID NO: 5552 - DNA, 21 bp, Homo sapiens
ggtatggcagctgcagctgag

SEQ ID NO: 5553 - DNA, 21 bp, Homo sapiens
catttacaatcaggaacttaa

SEQ ID NO: 5554 - DNA, 21 bp, Homo sapiens
caagttcctggccattgtctc

SEQ ID NO: 5555 - DNA, 21 bp, Homo sapiens
aagaaagaaaaagacataatg

SEQ ID NO: 5556 - DNA, 22 bp, Homo sapiens
tcagtggcagccgcaggccttg

SEQ ID NO: 5557 - DNA, 21 bp, Homo sapiens
aagatcctatgattgtttatg

SEQ ID NO: 5558 - DNA, 21 bp, Homo sapiens
taaccctctcgtatacaccct

SEQ ID NO: 5559 - DNA, 21 bp, Homo sapiens
gtgaatcctgatgatcctgac

SEQ ID NO: 5560 - DNA, 21 bp, Homo sapiens
atagcttttgaggaaatcatt

SEQ ID NO: 5561 - DNA, 21 bp, Homo sapiens
ggcctctgccctctgattatc

SEQ ID NO: 5562 - DNA, 21 bp, Homo sapiens
gcaggaggattctctgagtca

SEQ ID NO: 5563 - DNA, 21 bp, Homo sapiens
tgtgaagaatgtggcaaagct

SEQ ID NO: 5564 - DNA, 22 bp, Homo sapiens
taagttgtgcatcaccagccac

SEQ ID NO: 5565 - DNA, 21 bp, Homo sapiens
gagcgcgacgcggccaagcac

SEQ ID NO: 5566 - DNA, 21 bp, Homo sapiens
caaacatgtcgttggctgctt

SEQ ID NO: 5567 - DNA, 21 bp, Homo sapiens
gaggccataagaactagcact

SEQ ID NO: 5568 - DNA, 21 bp, Homo sapiens
tcagaaaagacgtgagtgagc

SEQ ID NO: 5569 - DNA, 21 bp, Homo sapiens
acagcccctcggctgccttct

SEQ ID NO: 5570 - DNA, 21 bp, Homo sapiens
tcacatttgtagggtctctct

SEQ ID NO: 5571 - DNA, 21 bp, Homo sapiens
tcatagcaccctttatgtgtt

SEQ ID NO: 5572 - DNA, 21 bp, Homo sapiens
ccagcggctcgcccacgtagc

SEQ ID NO: 5573 - DNA, 21 bp, Homo sapiens
gccaccttgaatcgtaccaac

SEQ ID NO: 5574 - DNA, 21 bp, Homo sapiens
aggctatctggggggctgggt

SEQ ID NO: 5575 - DNA, 22 bp, Homo sapiens
cagggtccacagcccccgccat

SEQ ID NO: 5576 - DNA, 21 bp, Homo sapiens
ttggtatgaaagtccttcctt

SEQ ID NO: 5577 - DNA, 21 bp, Homo sapiens
tccacaggggcgtgatgacag

SEQ ID NO: 5578 - DNA, 21 bp, Homo sapiens
ctgctcaggaggaactggacg

SEQ ID NO: 5579 - DNA, 21 bp, Homo sapiens
caggctcaggcggtcggaggt

SEQ ID NO: 5580 - DNA, 21 bp, Homo sapiens
tcagctcaaacgaacagcccc

SEQ ID NO: 5581 - DNA, 22 bp, Homo sapiens
gtagtggctgctgagtatgagc

SEQ ID NO: 5582 - DNA, 21 bp, Homo sapiens
caggcacctacattggatgct

SEQ ID NO: 5583 - DNA, 21 bp, Homo sapiens
cagggggagctgactccagcc

SEQ ID NO: 5584 - DNA, 21 bp, Homo sapiens
ctacagacgtcttccagatcg

SEQ ID NO: 5585 - DNA, 21 bp, Homo sapiens
ctcgatgcacgttgtgagagt

SEQ ID NO: 5586 - DNA, 21 bp, Homo sapiens
tcggaaattgcagccctttta

SEQ ID NO: 5587 - DNA, 21 bp, Homo sapiens
ggtgactgaccgggcccgcag

SEQ ID NO: 5588 - DNA, 21 bp, Homo sapiens
ctacattaaagtattggtgaa

SEQ ID NO: 5589 - DNA, 21 bp, Homo sapiens
ccgctccacacggacccggga

SEQ ID NO: 5590 - DNA, 21 bp, Homo sapiens
attgtgggccgccctcgccac

SEQ ID NO: 5591 - DNA, 21 bp, Homo sapiens
ttgttgtaagcggtcatgttc

SEQ ID NO: 5592 - DNA, 21 bp, Homo sapiens
tggagccaggcgcactggccg

SEQ ID NO: 5593 - DNA, 21 bp, Homo sapiens
agcagatccgagccagaagga

SEQ ID NO: 5594 - DNA, 21 bp, Homo sapiens
gaggcccagcgctgcagccag

SEQ ID NO: 5595 - DNA, 21 bp, Homo sapiens
cctcaccatgggtggttgctc

SEQ ID NO: 5596 - DNA, 21 bp, Homo sapiens
aggaggcggccacgtgcagtg

SEQ ID NO: 5597 - DNA, 21 bp, Homo sapiens
gggccatggcactcctgatca

SEQ ID NO: 5598 - DNA, 21 bp, Homo sapiens
cgtccctcagcgtgctcaccg

SEQ ID NO: 5599 - DNA, 21 bp, Homo sapiens
aggttggaaagaaatagaata

SEQ ID NO: 5600 - DNA, 21 bp, Homo sapiens
gcggctgtgtccatggtctct

SEQ ID NO: 5601 - DNA, 21 bp, Homo sapiens
tgactggcagcgctccagccg

SEQ ID NO: 5602 - DNA, 21 bp, Homo sapiens
tgaacagatacatttttttca

SEQ ID NO: 5603 - DNA, 21 bp, Homo sapiens
aaacggtacgcggagcataag

SEQ ID NO: 5604 - DNA, 21 bp, Homo sapiens
aaggaggaagctctctagatc

SEQ ID NO: 5605 - DNA, 21 bp, Homo sapiens
gcccgcgcctcgggcttccgg

SEQ ID NO: 5606 - DNA, 23 bp, Homo sapiens
tgcaacggccatgcccgccgctg

SEQ ID NO: 5607 - DNA, 21 bp, Homo sapiens
gggaaatgctgcaaacatctg

SEQ ID NO: 5608 - DNA, 21 bp, Homo sapiens
ataaatggcacgagtgattgg

SEQ ID NO: 5609 - DNA, 21 bp, Homo sapiens
tggaagtgtcgttaatgcctc

SEQ ID NO: 5610 - DNA, 21 bp, Homo sapiens
atccagttgacgaaagtaagt

SEQ ID NO: 5611 - DNA, 21 bp, Homo sapiens
gagctgtaccgggttttggag

SEQ ID NO: 5612 - DNA, 21 bp, Homo sapiens
ggccaggttctctttgctgtc

SEQ ID NO: 5613 - DNA, 21 bp, Homo sapiens
atggatccaagaaacgcagtg

SEQ ID NO: 5614 - DNA, 23 bp, Homo sapiens
gggcccatccacgccagccacat

SEQ ID NO: 5615 - DNA, 21 bp, Homo sapiens
gcgaggccgggatgagttggg

SEQ ID NO: 5616 - DNA, 21 bp, Homo sapiens
ctggcccagcgctgtggtgcc

SEQ ID NO: 5617 - DNA, 21 bp, Homo sapiens
cacggcagcacgccccaggtc

SEQ ID NO: 5618 - DNA, 20 bp, Homo sapiens
gatagaggcaggtctctcct

SEQ ID NO: 5619 - DNA, 21 bp, Homo sapiens
accttgctgccgccgccctcc

SEQ ID NO: 5620 - DNA, 21 bp, Homo sapiens
aaatataaatcggaggggaag

SEQ ID NO: 5621 - DNA, 21 bp, Homo sapiens
aaagagcgttcattcatgtgt

SEQ ID NO: 5622 - DNA, 21 bp, Homo sapiens
tccccggctcgcccagccagg

SEQ ID NO: 5623 - DNA, 21 bp, Homo sapiens
acccagcaatcgaccaataca

SEQ ID NO: 5624 - DNA, 21 bp, Homo sapiens
tggctgtctgcgacatcccgc

SEQ ID NO: 5625 - DNA, 21 bp, Homo sapiens
actcacagcagctgtagggac

SEQ ID NO: 5626 - DNA, 20 bp, Homo sapiens
tcaggtggccagaagccaca

SEQ ID NO: 5627 - DNA, 21 bp, Homo sapiens
gcgctggcatctggttcagtt

SEQ ID NO: 5628 - DNA, 21 bp, Homo sapiens
ccaggcggtggcatcgttggc

SEQ ID NO: 5629 - DNA, 21 bp, Homo sapiens
ctcgggctgtcatcgtggctc

SEQ ID NO: 5630 - DNA, 21 bp, Homo sapiens
aattcaggtcgcagatttttt

SEQ ID NO: 5631 - DNA, 22 bp, Homo sapiens
acattccagcagagagtcctgg

SEQ ID NO: 5632 - DNA, 21 bp, Homo sapiens
gcagaggcagcgcttcagatt

SEQ ID NO: 5633 - DNA, 20 bp, Homo sapiens
gtttgtggctgccttcaaca

SEQ ID NO: 5634 - DNA, 21 bp, Homo sapiens
tgaaggcgtgctggggctgct

SEQ ID NO: 5635 - DNA, 21 bp, Homo sapiens
ttctccgccgtcctgggctcc

SEQ ID NO: 5636 - DNA, 21 bp, Homo sapiens
agggcaggtatatatatatgt

SEQ ID NO: 5637 - DNA, 21 bp, Homo sapiens
agatgctaaaaaccttgtacc

SEQ ID NO: 5638 - DNA, 21 bp, Homo sapiens
caggaattaacgggctttcta

SEQ ID NO: 5639 - DNA, 21 bp, Homo sapiens
cggggtctgcgtctcccctct

SEQ ID NO: 5640 - DNA, 21 bp, Homo sapiens
aatgaaaagacgttaacaggt

SEQ ID NO: 5641 - DNA, 21 bp, Homo sapiens
tcttcccatttgctggaagcc

SEQ ID NO: 5642 - DNA, 21 bp, Homo sapiens
tggaaaggagaatgactttaa

SEQ ID NO: 5643 - DNA, 21 bp, Homo sapiens
ggcttttctcgagcaactgaa

SEQ ID NO: 5644 - DNA, 21 bp, Homo sapiens
aagacaatgcttggaatagtg

SEQ ID NO: 5645 - DNA, 21 bp, Homo sapiens
gcaccaaccagggtgggcacc

SEQ ID NO: 5646 - DNA, 21 bp, Homo sapiens
atgtggcgggcggggaggggc

SEQ ID NO: 5647 - DNA, 21 bp, Homo sapiens
ttagcccacacgagatcacaa

SEQ ID NO: 5648 - DNA, 21 bp, Homo sapiens
cgtctggatggaagtgagcac

SEQ ID NO: 5649 - DNA, 21 bp, Homo sapiens
atatgtaaaagatgggctgaa

SEQ ID NO: 5650 - DNA, 21 bp, Homo sapiens
atctttgttttcttgttttct

SEQ ID NO: 5651 - DNA, 21 bp, Homo sapiens
ggcccaggctctggagttgga

SEQ ID NO: 5652 - DNA, 23 bp, Homo sapiens
tagtggcaggacagcgatgtatc

SEQ ID NO: 5653 - DNA, 21 bp, Homo sapiens
tccaagtctgcgacctcacaa

SEQ ID NO: 5654 - DNA, 23 bp, Homo sapiens
caccggcagggcaggatccggac

SEQ ID NO: 5655 - DNA, 23 bp, Homo sapiens
ctactggcttggctgatgttact

SEQ ID NO: 5656 - DNA, 21 bp, Homo sapiens
agtattgccaatgtccattgc

SEQ ID NO: 5657 - DNA, 22 bp, Homo sapiens
ttagtggcggctgccacaaagc

SEQ ID NO: 5658 - DNA, 21 bp, Homo sapiens
tctgatatgaagcactccgtg

SEQ ID NO: 5659 - DNA, 21 bp, Homo sapiens
agctttggtgccacctgcgtg

SEQ ID NO: 5660 - DNA, 21 bp, Homo sapiens
ctttcctggcgtgctcattct

SEQ ID NO: 5661 - DNA, 21 bp, Homo sapiens
ttcattactcttcctccatcc

SEQ ID NO: 5662 - DNA, 21 bp, Homo sapiens
gtcccatttcttgcggtactc

SEQ ID NO: 5663 - DNA, 21 bp, Homo sapiens
aacatcttctcatacactgcc

SEQ ID NO: 5664 - DNA, 21 bp, Homo sapiens
ggaacgcacatgataaggatt

SEQ ID NO: 5665 - DNA, 21 bp, Homo sapiens
caaaatctggcccacaagtca

SEQ ID NO: 5666 - DNA, 21 bp, Homo sapiens
gccggtatgcgtatgtccgtg

SEQ ID NO: 5667 - DNA, 21 bp, Homo sapiens
gtttcaaccaacatggaagaa

SEQ ID NO: 5668 - DNA, 21 bp, Homo sapiens
gattcccgctccgagctcccg

SEQ ID NO: 5669 - DNA, 21 bp, Homo sapiens
cgccacccgctgggggccgcc

SEQ ID NO: 5670 - DNA, 21 bp, Homo sapiens
ctcgcccgtgctccgccgcca

SEQ ID NO: 5671 - DNA, 21 bp, Homo sapiens
gtttgtggattggtgccccac

SEQ ID NO: 5672 - DNA, 21 bp, Homo sapiens
tctcgcccgtgctccgccgcc

SEQ ID NO: 5673 - DNA, 21 bp, Homo sapiens
caaccaaaggctctgcaaatg

SEQ ID NO: 5674 - DNA, 21 bp, Homo sapiens
gttccaggtgtcagggggcct

SEQ ID NO: 5675 - DNA, 21 bp, Homo sapiens
ctgcgcccccctgtatgatgc

SEQ ID NO: 5676 - DNA, 21 bp, Homo sapiens
atggtggccacgaacttgtcc

SEQ ID NO: 5677 - DNA, 21 bp, Homo sapiens
ggttgaggttcaagccactaa

SEQ ID NO: 5678 - DNA, 21 bp, Homo sapiens
tttgatcaagttctgctctgg

SEQ ID NO: 5679 - DNA, 21 bp, Homo sapiens
tagtgtgaagtccggtagtcg

SEQ ID NO: 5680 - DNA, 21 bp, Homo sapiens
gatggtcaatgcggcgtcctc

SEQ ID NO: 5681 - DNA, 21 bp, Homo sapiens
cagtaagaccctattaaaaaa

SEQ ID NO: 5682 - DNA, 21 bp, Homo sapiens
acttctcctgctccccttcac

SEQ ID NO: 5683 - DNA, 21 bp, Homo sapiens
gcaacaaactcattctcaaca

SEQ ID NO: 5684 - DNA, 21 bp, Homo sapiens
ggtggtcaagcaggtaggaga

SEQ ID NO: 5685 - DNA, 21 bp, Homo sapiens
gggtggaatgcttccgccgtc

SEQ ID NO: 5686 - DNA, 21 bp, Homo sapiens
aagtgtaaatcgacacgtgtc

SEQ ID NO: 5687 - DNA, 21 bp, Homo sapiens
tcccatatccggttactggca

SEQ ID NO: 5688 - DNA, 21 bp, Homo sapiens
caggaaatcggacaccttatc

SEQ ID NO: 5689 - DNA, 20 bp, Homo sapiens
cacttatggcggttggggtg

SEQ ID NO: 5690 - DNA, 21 bp, Homo sapiens
atcctttcggctctctgggga

SEQ ID NO: 5691 - DNA, 21 bp, Homo sapiens
attttgtcaacattttctgtg

SEQ ID NO: 5692 - DNA, 21 bp, Homo sapiens
ggaccaccctgctggccggtg

SEQ ID NO: 5693 - DNA, 21 bp, Homo sapiens
agtacagtgcctcggcctccg

SEQ ID NO: 5694 - DNA, 21 bp, Homo sapiens
agtctggtggtgggaaatccg

SEQ ID NO: 5695 - DNA, 21 bp, Homo sapiens
agcggcacccgccctccgagg

SEQ ID NO: 5696 - DNA, 21 bp, Homo sapiens
cgatatctatgaccccttcca

SEQ ID NO: 5697 - DNA, 21 bp, Homo sapiens
gagtctgcggcggctgggact

SEQ ID NO: 5698 - DNA, 21 bp, Homo sapiens
aatcctgggccaactggatga

SEQ ID NO: 5699 - DNA, 21 bp, Homo sapiens
tttggccacattgaagcgaac

SEQ ID NO: 5700 - DNA, 21 bp, Homo sapiens
catgcttgctgtatactatga

SEQ ID NO: 5701 - DNA, 21 bp, Homo sapiens
aatattcaacgaagcagctga

SEQ ID NO: 5702 - DNA, 21 bp, Homo sapiens
aaaaactgcacctccatcagt

SEQ ID NO: 5703 - DNA, 21 bp, Homo sapiens
ggtgtcttctagctcctaaga

SEQ ID NO: 5704 - DNA, 21 bp, Homo sapiens
gctaccggagcccctcatagg

SEQ ID NO: 5705 - DNA, 21 bp, Homo sapiens
tgacgtgccctcgctggccac

SEQ ID NO: 5706 - DNA, 20 bp, Homo sapiens
gactattggcttggccagct

SEQ ID NO: 5707 - DNA, 21 bp, Homo sapiens
ggaggcacctacttcgtgacc

SEQ ID NO: 5708 - DNA, 21 bp, Homo sapiens
taactttcttgggctggattg

SEQ ID NO: 5709 - DNA, 21 bp, Homo sapiens
cccagcagagtgtaggtcaga

SEQ ID NO: 5710 - DNA, 21 bp, Homo sapiens
gctgcaggatcttggcgtagg

SEQ ID NO: 5711 - DNA, 21 bp, Homo sapiens
ctccctgaatcctctgcatgg

SEQ ID NO: 5712 - DNA, 21 bp, Homo sapiens
caggaggtcatggcatcgagt

SEQ ID NO: 5713 - DNA, 21 bp, Homo sapiens
cttaccagccattttgaccag

SEQ ID NO: 5714 - DNA, 21 bp, Homo sapiens
atgacctctgcgaggatgaac

SEQ ID NO: 5715 - DNA, 21 bp, Homo sapiens
aggcacactcgggggagaagc

SEQ ID NO: 5716 - DNA, 21 bp, Homo sapiens
ccagtgcactgagatgccccc

SEQ ID NO: 5717 - DNA, 21 bp, Homo sapiens
tgtttgcacacgacagttgag

SEQ ID NO: 5718 - DNA, 21 bp, Homo sapiens
gtcagcactctgtaagtcctt

SEQ ID NO: 5719 - DNA, 21 bp, Homo sapiens
gctcctctctgtttggccttg

SEQ ID NO: 5720 - DNA, 21 bp, Homo sapiens
cttgctcttcgtcggtgtgaa

SEQ ID NO: 5721 - DNA, 21 bp, Homo sapiens
tcctcaatgctcacatcagga

SEQ ID NO: 5722 - DNA, 21 bp, Homo sapiens
gccagaaagggtctcactggg

SEQ ID NO: 5723 - DNA, 21 bp, Homo sapiens
atgtcagacacgtaccagatc

SEQ ID NO: 5724 - DNA, 21 bp, Homo sapiens
actcacggttcgggggtatac

SEQ ID NO: 5725 - DNA, 22 bp, Homo sapiens
ggtgctcaccagccgccacaag

SEQ ID NO: 5726 - DNA, 21 bp, Homo sapiens
ttaccacaaagttgggatcct

SEQ ID NO: 5727 - DNA, 21 bp, Homo sapiens
gatatgttgcagctttttctg

SEQ ID NO: 5728 - DNA, 21 bp, Homo sapiens
tcatacggcagcagcacgagg

SEQ ID NO: 5729 - DNA, 21 bp, Homo sapiens
gcctgaggaacgacactcgaa

SEQ ID NO: 5730 - DNA, 22 bp, Homo sapiens
tctgggaaacagaactcagaac

SEQ ID NO: 5731 - DNA, 21 bp, Homo sapiens
ctgcctactttggcaagatca

SEQ ID NO: 5732 - DNA, 21 bp, Homo sapiens
agtactgacgatggctcctac

SEQ ID NO: 5733 - DNA, 21 bp, Homo sapiens
ggtgtggcccaggcagggcat

SEQ ID NO: 5734 - DNA, 21 bp, Homo sapiens
tgtatagaagcggtgatgggc

SEQ ID NO: 5735 - DNA, 21 bp, Homo sapiens
ggtgtggcccaggcagggcat

SEQ ID NO: 5736 - DNA, 21 bp, Homo sapiens
caaatttaagcaaaaatctta

SEQ ID NO: 5737 - DNA, 21 bp, Homo sapiens
tagcctcggcgaagcatgctg

SEQ ID NO: 5738 - DNA, 20 bp, Homo sapiens
attagtggataggctgacac

SEQ ID NO: 5739 - DNA, 22 bp, Homo sapiens
cagaggtggagcaagccatgaa

SEQ ID NO: 5740 - DNA, 21 bp, Homo sapiens
tgcttcttccaggtctccatt

SEQ ID NO: 5741 - DNA, 20 bp, Homo sapiens
cactgtggctggggcctgtg

SEQ ID NO: 5742 - DNA, 21 bp, Homo sapiens
gcgctggctccggcggaagaa

SEQ ID NO: 5743 - DNA, 21 bp, Homo sapiens
ccaccttgtcgttgctggaga

SEQ ID NO: 5744 - DNA, 21 bp, Homo sapiens
ctcgcttcccgtttcgcgtgg

SEQ ID NO: 5745 - DNA, 21 bp, Homo sapiens
agacacaaaacgcttttctca

SEQ ID NO: 5746 - DNA, 21 bp, Homo sapiens
cgcctcgaagctgtcatggaa

SEQ ID NO: 5747 - DNA, 21 bp, Homo sapiens
tacagcatctgatatccgaga

SEQ ID NO: 5748 - DNA, 21 bp, Homo sapiens
ctaagtcaagatggtattatg

SEQ ID NO: 5749 - DNA, 21 bp, Homo sapiens
ccaacacttacctctcccttc

SEQ ID NO: 5750 - DNA, 21 bp, Homo sapiens
ttggaatccacgctggaagct

SEQ ID NO: 5751 - DNA, 21 bp, Homo sapiens
atagggaatcccttctactta

SEQ ID NO: 5752 - DNA, 21 bp, Homo sapiens
tgcaccttctgacaacagcct

SEQ ID NO: 5753 - DNA, 23 bp, Homo sapiens
gcacaggttctcatcatgtgaca

SEQ ID NO: 5754 - DNA, 21 bp, Homo sapiens
aagcgggcgacggcccgggtg

SEQ ID NO: 5755 - DNA, 21 bp, Homo sapiens
gttgatattccggtactggca

SEQ ID NO: 5756 - DNA, 21 bp, Homo sapiens
gagacagcttgcaaggagcca

SEQ ID NO: 5757 - DNA, 21 bp, Homo sapiens
gaagtgagactgttttggatt

SEQ ID NO: 5758 - DNA, 21 bp, Homo sapiens
ctgatagggaatcccttctac

SEQ ID NO: 5759 - DNA, 21 bp, Homo sapiens
ccagcaggagcgcagccgttg

SEQ ID NO: 5760 - DNA, 21 bp, Homo sapiens
cagaggccccgccctcttgga

SEQ ID NO: 5761 - DNA, 21 bp, Homo sapiens
ggcgggagaacgtctcatccc

SEQ ID NO: 5762 - DNA, 20 bp, Homo sapiens
ctgcagtggcgggggaccgt

SEQ ID NO: 5763 - DNA, 21 bp, Homo sapiens
gtaaggatatttgctaaggct

SEQ ID NO: 5764 - DNA, 21 bp, Homo sapiens
cctggaactcggccaggccag

SEQ ID NO: 5765 - DNA, 21 bp, Homo sapiens
ggagaatgcacgcatctttca

SEQ ID NO: 5766 - DNA, 23 bp, Homo sapiens
gggcatgttcatgcccaccagcc

SEQ ID NO: 5767 - DNA, 21 bp, Homo sapiens
taagggctatgcaattgaatg

SEQ ID NO: 5768 - DNA, 21 bp, Homo sapiens
gatgccatcacgatggatacg

SEQ ID NO: 5769 - DNA, 23 bp, Homo sapiens
attgtggcttggctgcacccagg

SEQ ID NO: 5770 - DNA, 22 bp, Homo sapiens
agagtggagctgccctgccact

SEQ ID NO: 5771 - DNA, 20 bp, Homo sapiens
tgactcggctgggaaccacc

SEQ ID NO: 5772 - DNA, 21 bp, Homo sapiens
aatggtgaggcggataccctt

SEQ ID NO: 5773 - DNA, 21 bp, Homo sapiens
agcgacccagagggaactcgg

SEQ ID NO: 5774 - DNA, 23 bp, Homo sapiens
cctggccagcgggcccccgccac

SEQ ID NO: 5775 - DNA, 21 bp, Homo sapiens
cccaaaggtgcccacagcctc

SEQ ID NO: 5776 - DNA, 21 bp, Homo sapiens
ggtagttcttgttagtcagtg

SEQ ID NO: 5777 - DNA, 21 bp, Homo sapiens
cccaacattcgtcatctactg

SEQ ID NO: 5778 - DNA, 21 bp, Homo sapiens
gctgcccacggacctgcattt

SEQ ID NO: 5779 - DNA, 21 bp, Homo sapiens
ggtggtctgcgttatggctat

SEQ ID NO: 5780 - DNA, 23 bp, Homo sapiens
catgcatcaccaacagccaatag

SEQ ID NO: 5781 - DNA, 21 bp, Homo sapiens
gctgaggcgccgagtgtgcac

SEQ ID NO: 5782 - DNA, 21 bp, Homo sapiens
tcgcctgatcgaagttggacc

SEQ ID NO: 5783 - DNA, 21 bp, Homo sapiens
taataatggcgtagagagatg

SEQ ID NO: 5784 - DNA, 22 bp, Homo sapiens
acactggctgctgtggtcactg

SEQ ID NO: 5785 - DNA, 23 bp, Homo sapiens
atttcctaccactccagccatga

SEQ ID NO: 5786 - DNA, 22 bp, Homo sapiens
cccgggtcccagccgccagtcc

SEQ ID NO: 5787 - DNA, 21 bp, Homo sapiens
ccaggtgtccgtgtgtccctt

SEQ ID NO: 5788 - DNA, 21 bp, Homo sapiens
agattcataacgtgccaaatt

SEQ ID NO: 5789 - DNA, 21 bp, Homo sapiens
ctctatgtcgatgacccagac

SEQ ID NO: 5790 - DNA, 21 bp, Homo sapiens
tatcattactatgggattggc

SEQ ID NO: 5791 - DNA, 21 bp, Homo sapiens
gagaccagtatattgtggaca

SEQ ID NO: 5792 - DNA, 21 bp, Homo sapiens
ttaggatgtgccttttaagga

SEQ ID NO: 5793 - DNA, 21 bp, Homo sapiens
ctgcatgcagctgccttctgg

SEQ ID NO: 5794 - DNA, 22 bp, Homo sapiens
ctggagctgctacccccgccac

SEQ ID NO: 5795 - DNA, 21 bp, Homo sapiens
ccagcatggcgtttgaccaac

SEQ ID NO: 5796 - DNA, 21 bp, Homo sapiens
aaagaaagcccagcttcctta

SEQ ID NO: 5797 - DNA, 21 bp, Homo sapiens
cgtcacacacgtagggcctct

SEQ ID NO: 5798 - DNA, 21 bp, Homo sapiens
acatctggaggaagcaggctg

SEQ ID NO: 5799 - DNA, 21 bp, Homo sapiens
acttactgttctttgcattag

SEQ ID NO: 5800 - DNA, 21 bp, Homo sapiens
acatggctggctcttcagtgg

SEQ ID NO: 5801 - DNA, 21 bp, Homo sapiens
ttcctgacctcctgggcagac

SEQ ID NO: 5802 - DNA, 20 bp, Homo sapiens
cgctagtggcggtaggtgtg

SEQ ID NO: 5803 - DNA, 21 bp, Homo sapiens
tgtggctgtcgtggctgctct

SEQ ID NO: 5804 - DNA, 21 bp, Homo sapiens
tgtagataatccattcaagaa

SEQ ID NO: 5805 - DNA, 21 bp, Homo sapiens
cctacacagaccagggtgcta

SEQ ID NO: 5806 - DNA, 21 bp, Homo sapiens
aatatgctgcggaagttcttc

SEQ ID NO: 5807 - DNA, 21 bp, Homo sapiens
tctggccccacgcagccacca

SEQ ID NO: 5808 - DNA, 21 bp, Homo sapiens
caggaccctggctgcttcccg

SEQ ID NO: 5809 - DNA, 21 bp, Homo sapiens
tgtcttagtggccaaaattgt

SEQ ID NO: 5810 - DNA, 21 bp, Homo sapiens
aacacagaatacatcactgaa

SEQ ID NO: 5811 - DNA, 21 bp, Homo sapiens
aaacttcatcgtgagaatgac

SEQ ID NO: 5812 - DNA, 21 bp, Homo sapiens
ttcaccagctcccacttcaag

SEQ ID NO: 5813 - DNA, 21 bp, Homo sapiens
tgttcatccacgtagtagagt

SEQ ID NO: 5814 - DNA, 21 bp, Homo sapiens
aagggttggcgtagttttcac

SEQ ID NO: 5815 - DNA, 21 bp, Homo sapiens
gggccagggggacctcttgaa

SEQ ID NO: 5816 - DNA, 21 bp, Homo sapiens
tccagggtccggaggaagcca

SEQ ID NO: 5817 - DNA, 23 bp, Homo sapiens
agtgacaccctcacctgccagtg

SEQ ID NO: 5818 - DNA, 23 bp, Homo sapiens
cttatggctagtcagatgccaaa

SEQ ID NO: 5819 - DNA, 21 bp, Homo sapiens
tagattgcttgtggctggcag

SEQ ID NO: 5820 - DNA, 21 bp, Homo sapiens
agttcttcacggtcttggata

SEQ ID NO: 5821 - DNA, 23 bp, Homo sapiens
gcagcagcagcaacagtaacagc

SEQ ID NO: 5822 - DNA, 22 bp, Homo sapiens
gctcgccccctgcggcctctgc

SEQ ID NO: 5823 - DNA, 21 bp, Homo sapiens
agtctatcagaaccatgtaca

SEQ ID NO: 5824 - DNA, 21 bp, Homo sapiens
gaaaaagtctatcagaaccat

SEQ ID NO: 5825 - DNA, 21 bp, Homo sapiens
tgtaaaggccccggggccaca

SEQ ID NO: 5826 - DNA, 21 bp, Homo sapiens
cccgccaagccgcagcgggtg

SEQ ID NO: 5827 - DNA, 21 bp, Homo sapiens
ggattctaggagatgaaagaa

SEQ ID NO: 5828 - DNA, 21 bp, Homo sapiens
gcctggcaagggctgatacag

SEQ ID NO: 5829 - DNA, 21 bp, Homo sapiens
agtctatcagaaccatgtaca

SEQ ID NO: 5830 - DNA, 21 bp, Homo sapiens
ttggaagaaacgaaaggtcag

SEQ ID NO: 5831 - DNA, 21 bp, Homo sapiens
gctgaggatgcagggcaagaa

SEQ ID NO: 5832 - DNA, 21 bp, Homo sapiens
tcagcagttcgaactaatagt

SEQ ID NO: 5833 - DNA, 21 bp, Homo sapiens
ctgaagaaaagaaaagatatt

SEQ ID NO: 5834 - DNA, 21 bp, Homo sapiens
ggactgctccgtctggtacct

SEQ ID NO: 5835 - DNA, 23 bp, Homo sapiens
caagttaaaattcaagccattat

SEQ ID NO: 5836 - DNA, 23 bp, Homo sapiens
catgtaatcacatcattttcatc

SEQ ID NO: 5837 - DNA, 21 bp, Homo sapiens
aggtctctcctcccgccgtga

SEQ ID NO: 5838 - DNA, 21 bp, Homo sapiens
ccacttgcagcgagaggcggt

SEQ ID NO: 5839 - DNA, 21 bp, Homo sapiens
ccgttatgcgcgggactcgct

SEQ ID NO: 5840 - DNA, 21 bp, Homo sapiens
aggctgtgggaggcccagcat

SEQ ID NO: 5841 - DNA, 21 bp, Homo sapiens
caagggatggcccggtcctcc

SEQ ID NO: 5842 - DNA, 21 bp, Homo sapiens
agaagtaaacggaagatatta

SEQ ID NO: 5843 - DNA, 22 bp, Homo sapiens
gatatggcagctgcctgaacaa

SEQ ID NO: 5844 - DNA, 21 bp, Homo sapiens
ctcactgtttcgtaagctata

SEQ ID NO: 5845 - DNA, 21 bp, Homo sapiens
gctgccgtcacgggcgtggca

SEQ ID NO: 5846 - DNA, 21 bp, Homo sapiens
gaatgtgcccgttcacatcca

SEQ ID NO: 5847 - DNA, 22 bp, Homo sapiens
tcaccggcttgctgaccacaat

SEQ ID NO: 5848 - DNA, 21 bp, Homo sapiens
ccagtaacctgcagcacgagg

SEQ ID NO: 5849 - DNA, 21 bp, Homo sapiens
ttgatcgatgctgaccattag

SEQ ID NO: 5850 - DNA, 21 bp, Homo sapiens
ctggacccccggggaaaaagg

SEQ ID NO: 5851 - DNA, 21 bp, Homo sapiens
gctccggcccctgcagcagcc

SEQ ID NO: 5852 - DNA, 21 bp, Homo sapiens
ctgagggtggcgtttcgccgc

SEQ ID NO: 5853 - DNA, 21 bp, Homo sapiens
ctggttttgcgttctcttcct

SEQ ID NO: 5854 - DNA, 21 bp, Homo sapiens
ccagaaggagcctgggccacc

SEQ ID NO: 5855 - DNA, 21 bp, Homo sapiens
tggagaaaaggatgcagatgt

SEQ ID NO: 5856 - DNA, 23 bp, Homo sapiens
ctcctcctttggggtctgcagtt

SEQ ID NO: 5857 - DNA, 21 bp, Homo sapiens
agacagcacccgatggctgga

SEQ ID NO: 5858 - DNA, 21 bp, Homo sapiens
gaggagaaacgaaaagaacag

SEQ ID NO: 5859 - DNA, 21 bp, Homo sapiens
catcggcaggcgagtggctgt

SEQ ID NO: 5860 - DNA, 21 bp, Homo sapiens
cccgtggtatcgtcaatgata

SEQ ID NO: 5861 - DNA, 22 bp, Homo sapiens
gctgtggcggctgtacacaggg

SEQ ID NO: 5862 - DNA, 21 bp, Homo sapiens
tccagcagctcggcacgccgc

SEQ ID NO: 5863 - DNA, 21 bp, Homo sapiens
cagtgatgcccagggcccaga

SEQ ID NO: 5864 - DNA, 21 bp, Homo sapiens
ctctgcccagcgctgtgaggg

SEQ ID NO: 5865 - DNA, 21 bp, Homo sapiens
acatatcatattttcagtaat

SEQ ID NO: 5866 - DNA, 21 bp, Homo sapiens
cgactcgctggtacaaccttc

SEQ ID NO: 5867 - DNA, 21 bp, Homo sapiens
tcccattacccgctggcagga

SEQ ID NO: 5868 - DNA, 21 bp, Homo sapiens
cacagacggcgtaggtcccac

SEQ ID NO: 5869 - DNA, 23 bp, Homo sapiens
ggtatggcggtttgtttactctg

SEQ ID NO: 5870 - DNA, 21 bp, Homo sapiens
ggggggcactcgagccacacc

SEQ ID NO: 5871 - DNA, 21 bp, Homo sapiens
catgggcatcgtcagctggct

SEQ ID NO: 5872 - DNA, 21 bp, Homo sapiens
gagcttcggaggcgaagaccc

SEQ ID NO: 5873 - DNA, 21 bp, Homo sapiens
aggggtttcagtcgggggacc

SEQ ID NO: 5874 - DNA, 21 bp, Homo sapiens
cctgaagctagaccgacccac

SEQ ID NO: 5875 - DNA, 21 bp, Homo sapiens
attcaggatcgttttcactgt

SEQ ID NO: 5876 - DNA, 21 bp, Homo sapiens
ggctcgctgctgggagccaag

SEQ ID NO: 5877 - DNA, 22 bp, Homo sapiens
tgtgacaaacagagatatcatt

SEQ ID NO: 5878 - DNA, 21 bp, Homo sapiens
agccagatccgcgacacggag

SEQ ID NO: 5879 - DNA, 21 bp, Homo sapiens
tattgaagagcttggaaagct

SEQ ID NO: 5880 - DNA, 23 bp, Homo sapiens
ctggcacctccttccagccactc

SEQ ID NO: 5881 - DNA, 20 bp, Homo sapiens
cagtgtggctggtgccacga

SEQ ID NO: 5882 - DNA, 21 bp, Homo sapiens
gttttatgagcggtgtgaggt

SEQ ID NO: 5883 - DNA, 21 bp, Homo sapiens
agcagaagtcaggctgtaggt

SEQ ID NO: 5884 - DNA, 21 bp, Homo sapiens
tctccataaacttttcataat

SEQ ID NO: 5885 - DNA, 20 bp, Homo sapiens
cggaagcggcggttgcactc

SEQ ID NO: 5886 - DNA, 21 bp, Homo sapiens
gtctgcccagctgaaaacaag

SEQ ID NO: 5887 - DNA, 22 bp, Homo sapiens
ctatggctccagctgtgctgtg

SEQ ID NO: 5888 - DNA, 20 bp, Homo sapiens
ggctgtggctggccatcctc

SEQ ID NO: 5889 - DNA, 20 bp, Homo sapiens
tggagtggcagctttgtctt

SEQ ID NO: 5890 - DNA, 21 bp, Homo sapiens
cacaggttgcgcagctgcccc

SEQ ID NO: 5891 - DNA, 21 bp, Homo sapiens
cagtgaattcagccaccagaa

SEQ ID NO: 5892 - DNA, 22 bp, Homo sapiens
ctgacatctcttcctgccagtg

SEQ ID NO: 5893 - DNA, 21 bp, Homo sapiens
ctggcgcagcgcacgcagcaa

SEQ ID NO: 5894 - DNA, 22 bp, Homo sapiens
cagcccgagctgcctgccagca

SEQ ID NO: 5895 - DNA, 21 bp, Homo sapiens
gcaggcctctcatccagtgct

SEQ ID NO: 5896 - DNA, 21 bp, Homo sapiens
ggtggccttcgacatcatgtg

SEQ ID NO: 5897 - DNA, 21 bp, Homo sapiens
cctgcctctggctgtcgcgct

SEQ ID NO: 5898 - DNA, 21 bp, Homo sapiens
aggcggctcatagggcaccac

SEQ ID NO: 5899 - DNA, 21 bp, Homo sapiens
cgatcccagcgccatgacccc

SEQ ID NO: 5900 - DNA, 20 bp, Homo sapiens
cagaatggctggaggccttg

SEQ ID NO: 5901 - DNA, 21 bp, Homo sapiens
ataacacctacggaagaaaca

SEQ ID NO: 5902 - DNA, 22 bp, Homo sapiens
tctgtggctgctggaccccaat

SEQ ID NO: 5903 - DNA, 21 bp, Homo sapiens
ttgtggaggaggggcacaccg

SEQ ID NO: 5904 - DNA, 21 bp, Homo sapiens
ttttctttgaagaagaagtac

SEQ ID NO: 5905 - DNA, 21 bp, Homo sapiens
tggtccagaccctggtgaaga

SEQ ID NO: 5906 - DNA, 21 bp, Homo sapiens
gcaaagtctcgttttgtctaa

SEQ ID NO: 5907 - DNA, 21 bp, Homo sapiens
ctgagctgccgtatgtggaga

SEQ ID NO: 5908 - DNA, 21 bp, Homo sapiens
actttccatgtccgggtttac

SEQ ID NO: 5909 - DNA, 21 bp, Homo sapiens
cgagtgcaaaggacatgggta

SEQ ID NO: 5910 - DNA, 22 bp, Homo sapiens
ccagggtgtgctggagccggtc

SEQ ID NO: 5911 - DNA, 21 bp, Homo sapiens
atccatactcgaggactggat

SEQ ID NO: 5912 - DNA, 20 bp, Homo sapiens
caacagaggcttgcggggac

SEQ ID NO: 5913 - DNA, 21 bp, Homo sapiens
agggtgaaatcaaaattgctg

SEQ ID NO: 5914 - DNA, 21 bp, Homo sapiens
tctttcccaactgttctgctc

SEQ ID NO: 5915 - DNA, 21 bp, Homo sapiens
gtggccgtgacgcccgcgatg

SEQ ID NO: 5916 - DNA, 21 bp, Homo sapiens
tcctgttctgcgatttttctg

SEQ ID NO: 5917 - DNA, 21 bp, Homo sapiens
cagctttggtgccacctgcgt

SEQ ID NO: 5918 - DNA, 21 bp, Homo sapiens
gtgcagctccgccctcccctt

SEQ ID NO: 5919 - DNA, 21 bp, Homo sapiens
gaacctgggcctccatgtcgg

SEQ ID NO: 5920 - DNA, 21 bp, Homo sapiens
tgcagcagacccagcgatggt

SEQ ID NO: 5921 - DNA, 22 bp, Homo sapiens
gtgttgtggctgctgtggggta

SEQ ID NO: 5922 - DNA, 21 bp, Homo sapiens
tgtggctgctgtggggtaagt

SEQ ID NO: 5923 - DNA, 21 bp, Homo sapiens
gaaagcatccggccaattgtg

SEQ ID NO: 5924 - DNA, 21 bp, Homo sapiens
gatccctttttactcttaata

SEQ ID NO: 5925 - DNA, 21 bp, Homo sapiens
ttgcaatctagtctgttttca

SEQ ID NO: 5926 - DNA, 21 bp, Homo sapiens
agagcatgcagctcttgaggc

SEQ ID NO: 5927 - DNA, 21 bp, Homo sapiens
gcctttcgggcctggcagtcc

SEQ ID NO: 5928 - DNA, 21 bp, Homo sapiens
gtcggggagcggcctcaggca

SEQ ID NO: 5929 - DNA, 21 bp, Homo sapiens
caggtgccaggtgagacagca

SEQ ID NO: 5930 - DNA, 20 bp, Homo sapiens
ggcagtggctgccctcgtgg

SEQ ID NO: 5931 - DNA, 20 bp, Homo sapiens
aagactggctggaaaacaac

SEQ ID NO: 5932 - DNA, 20 bp, Homo sapiens
ttcttcagggccagccatat

SEQ ID NO: 5933 - DNA, 21 bp, Homo sapiens
cgcctcgctggttccagtggg

SEQ ID NO: 5934 - DNA, 21 bp, Homo sapiens
ttttcacctcgccatttggtc

SEQ ID NO: 5935 - DNA, 21 bp, Homo sapiens
cttttaactaagaacgtattc

SEQ ID NO: 5936 - DNA, 21 bp, Homo sapiens
ttggtctttcgaagatcatgg

SEQ ID NO: 5937 - DNA, 21 bp, Homo sapiens
tattgcagtacggacaatatt

SEQ ID NO: 5938 - DNA, 21 bp, Homo sapiens
cgctgttgacagatatggagt

SEQ ID NO: 5939 - DNA, 21 bp, Homo sapiens
gtttctggttccatttcaagc

SEQ ID NO: 5940 - DNA, 21 bp, Homo sapiens
caattagagtgcttccggggt

SEQ ID NO: 5941 - DNA, 21 bp, Homo sapiens
attgtccagacgcttcagctc

SEQ ID NO: 5942 - DNA, 23 bp, Homo sapiens
acccaaatccttgccctgccaat

SEQ ID NO: 5943 - DNA, 21 bp, Homo sapiens
cccgagtacacgcgccgcagt

SEQ ID NO: 5944 - DNA, 21 bp, Homo sapiens
gtcagcgggaccccctcctcg

SEQ ID NO: 5945 - DNA, 22 bp, Homo sapiens
cctccaattcatccagccactc

SEQ ID NO: 5946 - DNA, 22 bp, Homo sapiens
cggcccctgcagcagccagtga

SEQ ID NO: 5947 - DNA, 21 bp, Homo sapiens
ttcatggtgcacacctcatcg

SEQ ID NO: 5948 - DNA, 21 bp, Homo sapiens
catcttgttgagggcagggga

SEQ ID NO: 5949 - DNA, 21 bp, Homo sapiens
cggaaaatgacgtcacgggtg

SEQ ID NO: 5950 - DNA, 21 bp, Homo sapiens
accacctgccgctgctcagtg

SEQ ID NO: 5951 - DNA, 21 bp, Homo sapiens
cttagaagaagaatggctagc

SEQ ID NO: 5952 - DNA, 22 bp, Homo sapiens
accaagagccagcccagccacg

SEQ ID NO: 5953 - DNA, 21 bp, Homo sapiens
tgtcttagtggccaaaattgt

SEQ ID NO: 5954 - DNA, 21 bp, Homo sapiens
ctaaagaaacatgtcttagtg

SEQ ID NO: 5955 - DNA, 21 bp, Homo sapiens
aaccaaaatcctgtgaaccaa

SEQ ID NO: 5956 - DNA, 22 bp, Homo sapiens
tgaccatgccagccctgccgat

SEQ ID NO: 5957 - DNA, 21 bp, Homo sapiens
ggatttcccacgcccgtggtg

SEQ ID NO: 5958 - DNA, 21 bp, Homo sapiens
ctggactgctagctcaccaga

SEQ ID NO: 5959 - DNA, 21 bp, Homo sapiens
cacactgccccggccagtgtc

SEQ ID NO: 5960 - DNA, 21 bp, Homo sapiens
cttgagctctgtggccagccg

SEQ ID NO: 5961 - DNA, 21 bp, Homo sapiens
gaggctctgcgtggaactggc

SEQ ID NO: 5962 - DNA, 20 bp, Homo sapiens
ctaagtggcaggtccaatcc

SEQ ID NO: 5963 - DNA, 20 bp, Homo sapiens
ttcagtggctggtcaacaga

SEQ ID NO: 5964 - DNA, 21 bp, Homo sapiens
agccatgacacgcactcacaa

SEQ ID NO: 5965 - DNA, 23 bp, Homo sapiens
ggagcggcttcagtagctgaaac

SEQ ID NO: 5966 - DNA, 21 bp, Homo sapiens
gatggaggtccgggcatagct

SEQ ID NO: 5967 - DNA, 21 bp, Homo sapiens
tggaccctccgggggtcaaag

SEQ ID NO: 5968 - DNA, 21 bp, Homo sapiens
agtggccttacattcatgttc

SEQ ID NO: 5969 - DNA, 21 bp, Homo sapiens
gatgtagctcaggtaggtggc

SEQ ID NO: 5970 - DNA, 21 bp, Homo sapiens
atcttggccacgagattacgc

SEQ ID NO: 5971 - DNA, 22 bp, Homo sapiens
accccgagggacgagccgatgt

SEQ ID NO: 5972 - DNA, 23 bp, Homo sapiens
gagcggcaggtgaagtgggaaag

SEQ ID NO: 5973 - DNA, 21 bp, Homo sapiens
tgtgcagggcgtatcccaaag

SEQ ID NO: 5974 - DNA, 21 bp, Homo sapiens
tgtcccatttcttgcggtact

SEQ ID NO: 5975 - DNA, 21 bp, Homo sapiens
ttgcggcgtggggagtccctt

SEQ ID NO: 5976 - DNA, 21 bp, Homo sapiens
ttccaatatgatctccagggg

SEQ ID NO: 5977 - DNA, 21 bp, Homo sapiens
aactagccaatacttttgaag

SEQ ID NO: 5978 - DNA, 21 bp, Homo sapiens
gaactagccaatacttttgaa

SEQ ID NO: 5979 - DNA, 21 bp, Homo sapiens
aagtgtacaccaaaagctctc

SEQ ID NO: 5980 - DNA, 21 bp, Homo sapiens
ccatgaagtcgaagcggtggc

SEQ ID NO: 5981 - DNA, 21 bp, Homo sapiens
aatgggtggacggctcacctc

SEQ ID NO: 5982 - DNA, 21 bp, Homo sapiens
taggttaatcgaaaaaaaagt

SEQ ID NO: 5983 - DNA, 21 bp, Homo sapiens
aggaacttacctgcataactg

SEQ ID NO: 5984 - DNA, 21 bp, Homo sapiens
cgcccgtgctccgccgccagc

SEQ ID NO: 5985 - DNA, 21 bp, Homo sapiens
tcgcccgtgctccgccgccag

SEQ ID NO: 5986 - DNA, 21 bp, Homo sapiens
atactattatcctaatttcct

SEQ ID NO: 5987 - DNA, 21 bp, Homo sapiens
atctctgtttctgagtgacaa

SEQ ID NO: 5988 - DNA, 21 bp, Homo sapiens
cacagcagctgccccgtcctc

SEQ ID NO: 5989 - DNA, 21 bp, Homo sapiens
ggggagatgttcatgcggcca

SEQ ID NO: 5990 - DNA, 21 bp, Homo sapiens
ggagatgttcatgcggccagg

SEQ ID NO: 5991 - DNA, 21 bp, Homo sapiens
gggagatgttcatgcggccag

SEQ ID NO: 5992 - DNA, 21 bp, Homo sapiens
gtgaatgggaagtgacctcgt

SEQ ID NO: 5993 - DNA, 21 bp, Homo sapiens
aatgtgtttgagcaaacctcg

SEQ ID NO: 5994 - DNA, 21 bp, Homo sapiens
ttcaggtgcagactgctcatg

SEQ ID NO: 5995 - DNA, 21 bp, Homo sapiens
caggtgcagactgctcatgag

SEQ ID NO: 5996 - DNA, 21 bp, Homo sapiens
tttcaggtgcagactgctcat

SEQ ID NO: 5997 - DNA, 21 bp, Homo sapiens
ttacgctgacatccctgtgcg

SEQ ID NO: 5998 - DNA, 21 bp, Homo sapiens
atggtcaatgcggcgtcctcc

SEQ ID NO: 5999 - DNA, 21 bp, Homo sapiens
ggacccttccacgggctgcta

SEQ ID NO: 6000 - DNA, 21 bp, Homo sapiens
caacctcatgtttgccttctt

SEQ ID NO: 6001 - DNA, 21 bp, Homo sapiens
atacccaaagacacaagccaa

SEQ ID NO: 6002 - DNA, 21 bp, Homo sapiens
aggtggtcaagcaggtaggag

SEQ ID NO: 6003 - DNA, 21 bp, Homo sapiens
gggtggctccatccctgtctc

SEQ ID NO: 6004 - DNA, 21 bp, Homo sapiens
atcttcttcaggtctgagagg

SEQ ID NO: 6005 - DNA, 21 bp, Homo sapiens
tgaggatgatggccaggttct

SEQ ID NO: 6006 - DNA, 21 bp, Homo sapiens
aaccgagagacaagcatcttc

SEQ ID NO: 6007 - DNA, 21 bp, Homo sapiens
gctggtggccaatgtcacaaa

SEQ ID NO: 6008 - DNA, 21 bp, Homo sapiens
tcatcatcctcgtcatggccc

SEQ ID NO: 6009 - DNA, 21 bp, Homo sapiens
aatgagaagggtgccaacttc

SEQ ID NO: 6010 - DNA, 21 bp, Homo sapiens
tttgggccaccaccaacaaga

SEQ ID NO: 6011 - DNA, 21 bp, Homo sapiens
cataccattgatactccacag

SEQ ID NO: 6012 - DNA, 21 bp, Homo sapiens
ttgggccaccaccaacaagat

SEQ ID NO: 6013 - DNA, 21 bp, Homo sapiens
tagtttgggccaccaccaaca

SEQ ID NO: 6014 - DNA, 21 bp, Homo sapiens
ccataccattgatactccaca

SEQ ID NO: 6015 - DNA, 21 bp, Homo sapiens
agtttgggccaccaccaacaa

SEQ ID NO: 6016 - DNA, 21 bp, Homo sapiens
gtttgggccaccaccaacaag

SEQ ID NO: 6017 - DNA, 21 bp, Homo sapiens
ctcagtgtttcatcctcaggt

SEQ ID NO: 6018 - DNA, 21 bp, Homo sapiens
gctgtggggactgtggccgta

SEQ ID NO: 6019 - DNA, 21 bp, Homo sapiens
cgctgtggggactgtggccgt

SEQ ID NO: 6020 - DNA, 21 bp, Homo sapiens
gacagccacaagcttgtcttg

SEQ ID NO: 6021 - DNA, 21 bp, Homo sapiens
tcctggcactgctcttcgtcg

SEQ ID NO: 6022 - DNA, 21 bp, Homo sapiens
aataataatcgtcaatgccag

SEQ ID NO: 6023 - DNA, 21 bp, Homo sapiens
tcctggtgctgttgctttggg

SEQ ID NO: 6024 - DNA, 21 bp, Homo sapiens
ccggatgctgagtaccctgaa

SEQ ID NO: 6025 - DNA, 21 bp, Homo sapiens
accggtacatcgccattgtac

SEQ ID NO: 6026 - DNA, 21 bp, Homo sapiens
gtggctgctgagtatgagctg

SEQ ID NO: 6027 - DNA, 21 bp, Homo sapiens
gaccccacgcgctgctcctgg

SEQ ID NO: 6028 - DNA, 21 bp, Homo sapiens
gcctgctgaccggggcgatgg

SEQ ID NO: 6029 - DNA, 21 bp, Homo sapiens
agtcaatggcgtcctgccaga

SEQ ID NO: 6030 - DNA, 21 bp, Homo sapiens
aagcccgccgacatccctcag

SEQ ID NO: 6031 - DNA, 21 bp, Homo sapiens
ggtgccaaactgcgagaagtg

SEQ ID NO: 6032 - DNA, 21 bp, Homo sapiens
agacactgctggctgagaact

SEQ ID NO: 6033 - DNA, 21 bp, Homo sapiens
gacactgctggctgagaacta

SEQ ID NO: 6034 - DNA, 21 bp, Homo sapiens
agggcaggcatggctgttgca

SEQ ID NO: 6035 - DNA, 21 bp, Homo sapiens
attgacaactattttccagaa

SEQ ID NO: 6036 - DNA, 21 bp, Homo sapiens
gggcaggcatggctgttgcag

SEQ ID NO: 6037 - DNA, 21 bp, Homo sapiens
ctcaggtattacaggtattat

SEQ ID NO: 6038 - DNA, 21 bp, Homo sapiens
gtatgacgtgccctcgctggc

SEQ ID NO: 6039 - DNA, 22 bp, Homo sapiens
agggcagtctgcggcggtgttc

SEQ ID NO: 6040 - DNA, 21 bp, Homo sapiens
ggtgtgtggagaaatgcgcta

SEQ ID NO: 6041 - DNA, 21 bp, Homo sapiens
tgtggacaatttgcatatgtc

SEQ ID NO: 6042 - DNA, 21 bp, Homo sapiens
ggaggtcatggcatcgagttt

SEQ ID NO: 6043 - DNA, 21 bp, Homo sapiens
aggaggtcatggcatcgagtt

SEQ ID NO: 6044 - DNA, 21 bp, Homo sapiens
ttaccagaatgtgtgcacgca

SEQ ID NO: 6045 - DNA, 21 bp, Homo sapiens
gcaacgacgagaagaagatgt

SEQ ID NO: 6046 - DNA, 21 bp, Homo sapiens
cattcctggggctctgggccc

SEQ ID NO: 6047 - DNA, 21 bp, Homo sapiens
cccattcctggggctctgggc

SEQ ID NO: 6048 - DNA, 21 bp, Homo sapiens
cgcctcaagttcaaggagttt

SEQ ID NO: 6049 - DNA, 21 bp, Homo sapiens
ctgatccagctggtgtgggag

SEQ ID NO: 6050 - DNA, 21 bp, Homo sapiens
actccactcatcagttccttc

SEQ ID NO: 6051 - DNA, 21 bp, Homo sapiens
ctccactcatcagttccttcg

SEQ ID NO: 6052 - DNA, 21 bp, Homo sapiens
gggcacccacctgctggcctg

SEQ ID NO: 6053 - DNA, 21 bp, Homo sapiens
ccaagcaactagctcattgat

SEQ ID NO: 6054 - DNA, 21 bp, Homo sapiens
ccttacattcgtagggtttgt

SEQ ID NO: 6055 - DNA, 21 bp, Homo sapiens
gtgctttcggggtccgctgct

SEQ ID NO: 6056 - DNA, 21 bp, Homo sapiens
tcctcctttgggcctgaggac

SEQ ID NO: 6057 - DNA, 21 bp, Homo sapiens
actcactccactccctggtaa

SEQ ID NO: 6058 - DNA, 21 bp, Homo sapiens
tcatactaaatgctgaaaaaa

SEQ ID NO: 6059 - DNA, 21 bp, Homo sapiens
ggaattgagaaaggagcttca

SEQ ID NO: 6060 - DNA, 21 bp, Homo sapiens
caggaggtcatgtttgtgctg

SEQ ID NO: 6061 - DNA, 21 bp, Homo sapiens
agatttccgaatggcatttgg

SEQ ID NO: 6062 - DNA, 21 bp, Homo sapiens
gcttcttttacgtctgatttc

SEQ ID NO: 6063 - DNA, 21 bp, Homo sapiens
ggcaggttctcgcgctcgttg

SEQ ID NO: 6064 - DNA, 21 bp, Homo sapiens
gccagtgtccccgccaagctg

SEQ ID NO: 6065 - DNA, 20 bp, Homo sapiens
caagagtggcttcccaacta

SEQ ID NO: 6066 - DNA, 21 bp, Homo sapiens
tgcaacctacgtgaatgtaaa

SEQ ID NO: 6067 - DNA, 21 bp, Homo sapiens
aggcgggggacttctcaagta

SEQ ID NO: 6068 - DNA, 23 bp, Homo sapiens
acaggtcgtcgggcccgccgtta

SEQ ID NO: 6069 - DNA, 21 bp, Homo sapiens
tttttccccaaaagtttggca

SEQ ID NO: 6070 - DNA, 21 bp, Homo sapiens
agcgtgcgcgtaaagggtcgg

SEQ ID NO: 6071 - DNA, 21 bp, Homo sapiens
accatgtacagcatctgatat

SEQ ID NO: 6072 - DNA, 21 bp, Homo sapiens
gtacagcatctgatatccgag

SEQ ID NO: 6073 - DNA, 21 bp, Homo sapiens
ccggccagggcgacggccttt

SEQ ID NO: 6074 - DNA, 21 bp, Homo sapiens
atcagattcaacctaaaagta

SEQ ID NO: 6075 - DNA, 21 bp, Homo sapiens
tgccgccgccaccgccaccgc

SEQ ID NO: 6076 - DNA, 21 bp, Homo sapiens
ccaaatcatcgtactcaaagt

SEQ ID NO: 6077 - DNA, 21 bp, Homo sapiens
aggaggccgccgtcaccgctg

SEQ ID NO: 6078 - DNA, 21 bp, Homo sapiens
tgccgggctgcggagcagggt

SEQ ID NO: 6079 - DNA, 21 bp, Homo sapiens
ccttcctcctcccatgccctc

SEQ ID NO: 6080 - DNA, 21 bp, Homo sapiens
tggagctgacgctgggggtga

SEQ ID NO: 6081 - DNA, 21 bp, Homo sapiens
cgactggcaggttctctacaa

SEQ ID NO: 6082 - DNA, 21 bp, Homo sapiens
atagggaatcccttctactta

SEQ ID NO: 6083 - DNA, 21 bp, Homo sapiens
ggaagaggggcagcacggccc

SEQ ID NO: 6084 - DNA, 21 bp, Homo sapiens
gccaaatcatcgtactcaaag

SEQ ID NO: 6085 - DNA, 21 bp, Homo sapiens
agggtacatacagttttcttc

SEQ ID NO: 6086 - DNA, 21 bp, Homo sapiens
aactgtcactcgggtcattgt

SEQ ID NO: 6087 - DNA, 21 bp, Homo sapiens
gtgagggagggggtgatatcc

SEQ ID NO: 6088 - DNA, 21 bp, Homo sapiens
caggtgaagatgttgtccctt

SEQ ID NO: 6089 - DNA, 21 bp, Homo sapiens
aaaagatgtcgccttggcccg

SEQ ID NO: 6090 - DNA, 21 bp, Homo sapiens
tactcccagatgcatccgtgt

SEQ ID NO: 6091 - DNA, 23 bp, Homo sapiens
tatcggcaggtatgtgtgtgttg

SEQ ID NO: 6092 - DNA, 21 bp, Homo sapiens
tcacctcattgtctgtcttct

SEQ ID NO: 6093 - DNA, 20 bp, Homo sapiens
ggatgtggctggccagtctt

SEQ ID NO: 6094 - DNA, 20 bp, Homo sapiens
tgactcggctgggaaccacc

SEQ ID NO: 6095 - DNA, 23 bp, Homo sapiens
ccacggcgggtcaggcggcccag

SEQ ID NO: 6096 - DNA, 22 bp, Homo sapiens
cctgtggcttggtggtactcca

SEQ ID NO: 6097 - DNA, 21 bp, Homo sapiens
ttatcgaagccgctccaggtg

SEQ ID NO: 6098 - DNA, 20 bp, Homo sapiens
gggagcggctggaatttgtc

SEQ ID NO: 6099 - DNA, 21 bp, Homo sapiens
gaaaaagtctatcagaaccat

SEQ ID NO: 6100 - DNA, 21 bp, Homo sapiens
agtctatcagaaccatgtaca

SEQ ID NO: 6101 - DNA, 21 bp, Homo sapiens
caggaaagggggaaataacaa

SEQ ID NO: 6102 - DNA, 22 bp, Homo sapiens
gctgagccgcatccctgccact

SEQ ID NO: 6103 - DNA, 21 bp, Homo sapiens
gtgtgtgctacggcgaaggcc

SEQ ID NO: 6104 - DNA, 21 bp, Homo sapiens
tctaggaaatctgtgctcagt

SEQ ID NO: 6105 - DNA, 21 bp, Homo sapiens
gaaaaccagcgtctggtgtct

SEQ ID NO: 6106 - DNA, 20 bp, Homo sapiens
taatatggctgtttctctag

SEQ ID NO: 6107 - DNA, 21 bp, Homo sapiens
gtcagtccacggtgaggctcg

SEQ ID NO: 6108 - DNA, 20 bp, Homo sapiens
ggtagaggctgggctgttgg

SEQ ID NO: 6109 - DNA, 21 bp, Homo sapiens
tttacttggcgtcaccccagg

SEQ ID NO: 6110 - DNA, 21 bp, Homo sapiens
cctctgcgcgcggcgacctac

SEQ ID NO: 6111 - DNA, 21 bp, Homo sapiens
ctgtggacaccggctggccat

SEQ ID NO: 6112 - DNA, 21 bp, Homo sapiens
atctcgacggcgctgaaggaa

SEQ ID NO: 6113 - DNA, 21 bp, Homo sapiens
attgcccgtcagaagctttta

SEQ ID NO: 6114 - DNA, 21 bp, Homo sapiens
aagaaagcccagcttccttac

SEQ ID NO: 6115 - DNA, 21 bp, Homo sapiens
accacctgtggcaaggacttc

SEQ ID NO: 6116 - DNA, 21 bp, Homo sapiens
cttcctaggtgagtcagtaac

SEQ ID NO: 6117 - DNA, 21 bp, Homo sapiens
tcagcattgccgcccgcggcc

SEQ ID NO: 6118 - DNA, 21 bp, Homo sapiens
gcactttacctgaaaagtgtt

SEQ ID NO: 6119 - DNA, 21 bp, Homo sapiens
ggcaccagtgcggacctgccc

SEQ ID NO: 6120 - DNA, 21 bp, Homo sapiens
ggacccggtccggcgacagga

SEQ ID NO: 6121 - DNA, 21 bp, Homo sapiens
ggctttaaagcagtggttgcc

SEQ ID NO: 6122 - DNA, 21 bp, Homo sapiens
agatataccgcgaatacctga

SEQ ID NO: 6123 - DNA, 21 bp, Homo sapiens
ggatgtggcggtagaggtccc

SEQ ID NO: 6124 - DNA, 23 bp, Homo sapiens
tgcaagctggccaggtacctgga

SEQ ID NO: 6125 - DNA, 20 bp, Homo sapiens
gtcccaggggcagccactgg

SEQ ID NO: 6126 - DNA, 21 bp, Homo sapiens
ggttgaacagcaagcccccgc

SEQ ID NO: 6127 - DNA, 21 bp, Homo sapiens
cccatgccccgcagcatggcc

SEQ ID NO: 6128 - DNA, 21 bp, Homo sapiens
catcggaggattcacacagga

SEQ ID NO: 6129 - DNA, 21 bp, Homo sapiens
gagcggcaggcgcaccagctg

SEQ ID NO: 6130 - DNA, 21 bp, Homo sapiens
gagaacaagaccattgcccac

SEQ ID NO: 6131 - DNA, 20 bp, Homo sapiens
ggcagtggctgccgctcctc

SEQ ID NO: 6132 - DNA, 21 bp, Homo sapiens
gaactctccaactacaaacat

SEQ ID NO: 6133 - DNA, 21 bp, Homo sapiens
tcgcagtcatcgaaggactcc

SEQ ID NO: 6134 - DNA, 21 bp, Homo sapiens
ttgcggagcacgggccagatt

SEQ ID NO: 6135 - DNA, 21 bp, Homo sapiens
ttggctcaaacgagtgtctcc

SEQ ID NO: 6136 - DNA, 23 bp, Homo sapiens
aatctccaccacacctgccatac

SEQ ID NO: 6137 - DNA, 21 bp, Homo sapiens
gtgctagcaccagcagcccag

SEQ ID NO: 6138 - DNA, 21 bp, Homo sapiens
gtgaagttacgaaaattggag

SEQ ID NO: 6139 - DNA, 23 bp, Homo sapiens
atgtggcaggagtggggccccac

SEQ ID NO: 6140 - DNA, 22 bp, Homo sapiens
acaatggcggctgctcccacct

SEQ ID NO: 6141 - DNA, 21 bp, Homo sapiens
tgattcccaacggagacattg

SEQ ID NO: 6142 - DNA, 21 bp, Homo sapiens
tgtcaagtatggtggttgtca

SEQ ID NO: 6143 - DNA, 21 bp, Homo sapiens
atcactttcagacctacgaga

SEQ ID NO: 6144 - DNA, 22 bp, Homo sapiens
ctatcggcagcagcagcagctc

SEQ ID NO: 6145 - DNA, 21 bp, Homo sapiens
tgggcttgaaggtatgagctc

SEQ ID NO: 6146 - DNA, 21 bp, Homo sapiens
gtgggagacacgccaaagctc

SEQ ID NO: 6147 - DNA, 21 bp, Homo sapiens
agccagcaccgataggagaat

SEQ ID NO: 6148 - DNA, 21 bp, Homo sapiens
tccacctccacgttgaggcgg

SEQ ID NO: 6149 - DNA, 21 bp, Homo sapiens
ataccggcgccagggcaagct

SEQ ID NO: 6150 - DNA, 21 bp, Homo sapiens
agcagcgaccgcaagaagcac

SEQ ID NO: 6151 - DNA, 21 bp, Homo sapiens
tgctggccttcgaggtgaccg

SEQ ID NO: 6152 - DNA, 21 bp, Homo sapiens
ggatgaactggcatctttaaa

SEQ ID NO: 6153 - DNA, 21 bp, Homo sapiens
gtttttctccgtgctataaat

SEQ ID NO: 6154 - DNA, 21 bp, Homo sapiens
acagtggtggcgagggtagca

SEQ ID NO: 6155 - DNA, 21 bp, Homo sapiens
accataatggcggtgtagaag

SEQ ID NO: 6156 - DNA, 21 bp, Homo sapiens
gtggcagtgaagggtgcgtgc

SEQ ID NO: 6157 - DNA, 21 bp, Homo sapiens
gttcacaaaggtatataaccc

SEQ ID NO: 6158 - DNA, 21 bp, Homo sapiens
ggaggctggtcattgtcacta

SEQ ID NO: 6159 - DNA, 21 bp, Homo sapiens
tctggatgggcgccccataga

SEQ ID NO: 6160 - DNA, 23 bp, Homo sapiens
gtacggcaggctcggacacagcg

SEQ ID NO: 6161 - DNA, 21 bp, Homo sapiens
cgcacagcacgcggccgcagg

SEQ ID NO: 6162 - DNA, 21 bp, Homo sapiens
cggggcgcctcctctgcccgc

SEQ ID NO: 6163 - DNA, 22 bp, Homo sapiens
gctgcggcggctgcttccgcac

SEQ ID NO: 6164 - DNA, 21 bp, Homo sapiens
tcagcatccacgtatttcttt

SEQ ID NO: 6165 - DNA, 21 bp, Homo sapiens
aaaggtttgaggcctcattat

SEQ ID NO: 6166 - DNA, 21 bp, Homo sapiens
ttgaaaatttcctcccttttt

SEQ ID NO: 6167 - DNA, 21 bp, Homo sapiens
tgcctggttctgttgtcctac

SEQ ID NO: 6168 - DNA, 21 bp, Homo sapiens
cagtcagctcccggcccgtgg

SEQ ID NO: 6169 - DNA, 21 bp, Homo sapiens
gggtatcctcatatgcccagc

SEQ ID NO: 6170 - DNA, 21 bp, Homo sapiens
ggttgtggatgtgaatgacaa

SEQ ID NO: 6171 - DNA, 21 bp, Homo sapiens
atcaaatagcggttgaggaaa

SEQ ID NO: 6172 - DNA, 21 bp, Homo sapiens
ccttgtggcggcctgccaggc

SEQ ID NO: 6173 - DNA, 23 bp, Homo sapiens
aggaataggcaggcctgccattc

SEQ ID NO: 6174 - DNA, 21 bp, Homo sapiens
cttgcatccgctatcacctta

SEQ ID NO: 6175 - DNA, 21 bp, Homo sapiens
atcttgcttacgagggccaca

SEQ ID NO: 6176 - DNA, 21 bp, Homo sapiens
gagcaatgagcttgaacacgg

SEQ ID NO: 6177 - DNA, 21 bp, Homo sapiens
gaattgctttcggctgaaaca

SEQ ID NO: 6178 - DNA, 21 bp, Homo sapiens
gcggccgccgggttcctcttc

SEQ ID NO: 6179 - DNA, 21 bp, Homo sapiens
gacgctgagccggatctcccc

SEQ ID NO: 6180 - DNA, 21 bp, Homo sapiens
tgttttcttcctaggggttct

SEQ ID NO: 6181 - DNA, 21 bp, Homo sapiens
ccgatccatacggagaaattc

SEQ ID NO: 6182 - DNA, 22 bp, Homo sapiens
gtcggctgggcaggatgctggg

SEQ ID NO: 6183 - DNA, 21 bp, Homo sapiens
cctttgccctcacggaagggc

SEQ ID NO: 6184 - DNA, 21 bp, Homo sapiens
gatattcaccacaaaacatcc

SEQ ID NO: 6185 - DNA, 21 bp, Homo sapiens
ttataaaaaaggttagtagat

SEQ ID NO: 6186 - DNA, 21 bp, Homo sapiens
caggcagcagcagtgaggcgg

SEQ ID NO: 6187 - DNA, 21 bp, Homo sapiens
gggaccacccgcacccctgca

SEQ ID NO: 6188 - DNA, 21 bp, Homo sapiens
cctggatcttgggccaggata

SEQ ID NO: 6189 - DNA, 23 bp, Homo sapiens
atctggtcgccggcagccgcgcc

SEQ ID NO: 6190 - DNA, 21 bp, Homo sapiens
cagcgaagtcgagttgtgttg

SEQ ID NO: 6191 - DNA, 21 bp, Homo sapiens
cttccagccccgagaatgctc

SEQ ID NO: 6192 - DNA, 21 bp, Homo sapiens
gcagcactgacggccttcttc

SEQ ID NO: 6193 - DNA, 21 bp, Homo sapiens
acattcatagggtttttctcc

SEQ ID NO: 6194 - DNA, 21 bp, Homo sapiens
catcacaaccgccagaaagat

SEQ ID NO: 6195 - DNA, 21 bp, Homo sapiens
tcttctgaatgatgatgtgac

SEQ ID NO: 6196 - DNA, 21 bp, Homo sapiens
gtggagagtctctgtcatgac

SEQ ID NO: 6197 - DNA, 21 bp, Homo sapiens
gccaggcccccgtgctctact

SEQ ID NO: 6198 - DNA, 21 bp, Homo sapiens
cccagctgcacgcagagcagg

SEQ ID NO: 6199 - DNA, 22 bp, Homo sapiens
gccagagaccagcctgccactc

SEQ ID NO: 6200 - DNA, 21 bp, Homo sapiens
cactggatccgcggatgagct

SEQ ID NO: 6201 - DNA, 22 bp, Homo sapiens
cagcaaggacagcagccagtgt

SEQ ID NO: 6202 - DNA, 20 bp, Homo sapiens
ggctgtggctggggctggtg

SEQ ID NO: 6203 - DNA, 21 bp, Homo sapiens
aagtaatgaagttacactctc

SEQ ID NO: 6204 - DNA, 21 bp, Homo sapiens
gcagtattaccaccgaaagta

SEQ ID NO: 6205 - DNA, 23 bp, Homo sapiens
cagaggcaggagaggctgcagcc

SEQ ID NO: 6206 - DNA, 21 bp, Homo sapiens
tcagcctcttcggcatatcct

SEQ ID NO: 6207 - DNA, 22 bp, Homo sapiens
tgcccacggcagccgccgctgt

SEQ ID NO: 6208 - DNA, 21 bp, Homo sapiens
aaagccttttcgcattttaat

SEQ ID NO: 6209 - DNA, 21 bp, Homo sapiens
aatgctggctcacaaagcaga

SEQ ID NO: 6210 - DNA, 21 bp, Homo sapiens
ggcacttgcggaccttgggcc

SEQ ID NO: 6211 - DNA, 21 bp, Homo sapiens
tgatactgcacaatatgtggg

SEQ ID NO: 6212 - DNA, 21 bp, Homo sapiens
tgagagtgaaccttctggggg

SEQ ID NO: 6213 - DNA, 21 bp, Homo sapiens
tacttactgcgaggcgccagt

SEQ ID NO: 6214 - DNA, 23 bp, Homo sapiens
agcccagggcaggctgccattct

SEQ ID NO: 6215 - DNA, 22 bp, Homo sapiens
tttgtggctgtcgatctcagtg

SEQ ID NO: 6216 - DNA, 21 bp, Homo sapiens
agaggcccgtctcacagccca

SEQ ID NO: 6217 - DNA, 23 bp, Homo sapiens
ctactggcttggctgatgttact

SEQ ID NO: 6218 - DNA, 21 bp, Homo sapiens
gaggaaaaacgtcaagaagag

SEQ ID NO: 6219 - DNA, 21 bp, Homo sapiens
atatggctggagactggcact

SEQ ID NO: 6220 - DNA, 22 bp, Homo sapiens
catggctgggtaggcggcctgg

SEQ ID NO: 6221 - DNA, 21 bp, Homo sapiens
ctcaggcgagcgtggcccctc

SEQ ID NO: 6222 - DNA, 21 bp, Homo sapiens
cagtggctggagtggcccctt

SEQ ID NO: 6223 - DNA, 23 bp, Homo sapiens
gcatggcaggcacggtgaatgtg

SEQ ID NO: 6224 - DNA, 21 bp, Homo sapiens
gtcttctgatccaggtcatca

SEQ ID NO: 6225 - DNA, 21 bp, Homo sapiens
tctcctaattcacagaacaga

SEQ ID NO: 6226 - DNA, 21 bp, Homo sapiens
gacatccaaggcccaacaaag

SEQ ID NO: 6227 - DNA, 21 bp, Homo sapiens
cggaaaaagcgtttcgggcag

SEQ ID NO: 6228 - DNA, 22 bp, Homo sapiens
cagaggccactgccctgccatt

SEQ ID NO: 6229 - DNA, 21 bp, Homo sapiens
tgccaacaacgtccacgatgc

SEQ ID NO: 6230 - DNA, 21 bp, Homo sapiens
ccctcggagaggaaattggag

SEQ ID NO: 6231 - DNA, 21 bp, Homo sapiens
agagtggccggcctgaacagt

SEQ ID NO: 6232 - DNA, 21 bp, Homo sapiens
cagcacagccccttcctgaca

SEQ ID NO: 6233 - DNA, 21 bp, Homo sapiens
cctccggaggcccttgaaatc

SEQ ID NO: 6234 - DNA, 21 bp, Homo sapiens
cactatctgacgtggttctcc

SEQ ID NO: 6235 - DNA, 21 bp, Homo sapiens
agaaagggctctggaagagca

SEQ ID NO: 6236 - DNA, 21 bp, Homo sapiens
gaggtaaggcgaagagggctg

SEQ ID NO: 6237 - DNA, 21 bp, Homo sapiens
gttgaaccaaagatgaaggct

SEQ ID NO: 6238 - DNA, 21 bp, Homo sapiens
cccacagctccagcccctcca

SEQ ID NO: 6239 - DNA, 21 bp, Homo sapiens
tccttgttccgcaaagtgtaa

SEQ ID NO: 6240 - DNA, 21 bp, Homo sapiens
ctgcccaccacgggggggtga

SEQ ID NO: 6241 - DNA, 22 bp, Homo sapiens
ttgtggcaggcagacacccagg

SEQ ID NO: 6242 - DNA, 21 bp, Homo sapiens
aagatggcttcatgatggatg

SEQ ID NO: 6243 - DNA, 21 bp, Homo sapiens
ttctgcaagaggtatatatta

SEQ ID NO: 6244 - DNA, 21 bp, Homo sapiens
ctgccagaaagagtaagctct

SEQ ID NO: 6245 - DNA, 21 bp, Homo sapiens
aaggctgtaaattattcatta

SEQ ID NO: 6246 - DNA, 22 bp, Homo sapiens
ggaaagccgatgaagccactgc

SEQ ID NO: 6247 - DNA, 22 bp, Homo sapiens
ctctctgcgtagtagccagtaa

SEQ ID NO: 6248 - DNA, 21 bp, Homo sapiens
tggaaagggacgaactggtgt

SEQ ID NO: 6249 - DNA, 21 bp, Homo sapiens
gcagatgatccgccaccccaa

SEQ ID NO: 6250 - DNA, 21 bp, Homo sapiens
ctgatagggaatcccttctac

SEQ ID NO: 6251 - DNA, 21 bp, Homo sapiens
agactggtaggatgatatttt

SEQ ID NO: 6252 - DNA, 21 bp, Homo sapiens
gcaaatttggcgccatcctgg

SEQ ID NO: 6253 - DNA, 21 bp, Homo sapiens
ggctgcacaccgtgaagatgt

SEQ ID NO: 6254 - DNA, 21 bp, Homo sapiens
aggtatataacgagttcattc

SEQ ID NO: 6255 - DNA, 21 bp, Homo sapiens
atctgatggccccttctgaag

SEQ ID NO: 6256 - DNA, 21 bp, Homo sapiens
agccctggacctggatgctgg

SEQ ID NO: 6257 - DNA, 21 bp, Homo sapiens
ggaccacagacgaggtttatt

SEQ ID NO: 6258 - DNA, 20 bp, Homo sapiens
ggatgtggctggccagtctt

SEQ ID NO: 6259 - DNA, 22 bp, Homo sapiens
cgagtggctcgtcagcaatggc

SEQ ID NO: 6260 - DNA, 21 bp, Homo sapiens
ccttggcaaacgaggggatct

SEQ ID NO: 6261 - DNA, 20 bp, Homo sapiens
ttcattggcaggaaagttgg

SEQ ID NO: 6262 - DNA, 21 bp, Homo sapiens
tggagatgctctaccaccacg

SEQ ID NO: 6263 - DNA, 20 bp, Homo sapiens
ggttgcggctgttgtccatg

SEQ ID NO: 6264 - DNA, 21 bp, Homo sapiens
tttgcagttcccatggtgcac

SEQ ID NO: 6265 - DNA, 21 bp, Homo sapiens
gcgcaagttcgtgctctacga

SEQ ID NO: 6266 - DNA, 21 bp, Homo sapiens
attcattactcttcctccatc

SEQ ID NO: 6267 - DNA, 21 bp, Homo sapiens
cttccaatatgatctccaggg

SEQ ID NO: 6268 - DNA, 21 bp, Homo sapiens
cggccaggggcgaggcgtcca

SEQ ID NO: 6269 - DNA, 21 bp, Homo sapiens
cacggctttctggctgccgaa

SEQ ID NO: 6270 - DNA, 21 bp, Homo sapiens
gtacatgttccgccacaaggg

SEQ ID NO: 6271 - DNA, 21 bp, Homo sapiens
accactggcacgggaggggtg

SEQ ID NO: 6272 - DNA, 21 bp, Homo sapiens
catgacaccacggccagtggc

SEQ ID NO: 6273 - DNA, 23 bp, Homo sapiens
tcaataatcattcaagccacaga

SEQ ID NO: 6274 - DNA, 21 bp, Homo sapiens
tctaccgcaacgactacgcca

SEQ ID NO: 6275 - DNA, 21 bp, Homo sapiens
gcccgtgctccgccgccagcc

SEQ ID NO: 6276 - DNA, 21 bp, Homo sapiens
tttgtggattggtgccccact

SEQ ID NO: 6277 - DNA, 21 bp, Homo sapiens
taggcatgtaaaggactctct

SEQ ID NO: 6278 - DNA, 21 bp, Homo sapiens
tgcctcgcttattcatctcgg

SEQ ID NO: 6279 - DNA, 21 bp, Homo sapiens
gtgagaggatgcacttctggc

SEQ ID NO: 6280 - DNA, 21 bp, Homo sapiens
agacagcgtgattctgattaa

SEQ ID NO: 6281 - DNA, 21 bp, Homo sapiens
aaccaaaggctctgcaaatga

SEQ ID NO: 6282 - DNA, 21 bp, Homo sapiens
acaggctgccaacaacgtgcg

SEQ ID NO: 6283 - DNA, 21 bp, Homo sapiens
cacaggctgccaacaacgtgc

SEQ ID NO: 6284 - DNA, 21 bp, Homo sapiens
aaaagaaaaagaaaaagaaaa

SEQ ID NO: 6285 - DNA, 21 bp, Homo sapiens
ttctggacagggcgccggatt

SEQ ID NO: 6286 - DNA, 21 bp, Homo sapiens
cgatgcccctgttccctcacg

SEQ ID NO: 6287 - DNA, 21 bp, Homo sapiens
tggggagatgttcatgcggcc

SEQ ID NO: 6288 - DNA, 21 bp, Homo sapiens
atggggagatgttcatgcggc

SEQ ID NO: 6289 - DNA, 21 bp, Homo sapiens
gcgatgcactgtcgaggcccc

SEQ ID NO: 6290 - DNA, 21 bp, Homo sapiens
gctcccagtgcgctggatggc

SEQ ID NO: 6291 - DNA, 21 bp, Homo sapiens
gtaagaccctattaaaaaatc

SEQ ID NO: 6292 - DNA, 21 bp, Homo sapiens
tgggcctgcgcccgcaccctg

SEQ ID NO: 6293 - DNA, 21 bp, Homo sapiens
ctgggcctgcgcccgcaccct

SEQ ID NO: 6294 - DNA, 21 bp, Homo sapiens
tggtcaagcaggtaggagagg

SEQ ID NO: 6295 - DNA, 21 bp, Homo sapiens
cttctcctgctccccttcact

SEQ ID NO: 6296 - DNA, 21 bp, Homo sapiens
ggtcaagcaggtaggagaggt

SEQ ID NO: 6297 - DNA, 21 bp, Homo sapiens
cgtggtgtgctggttcccctt

SEQ ID NO: 6298 - DNA, 21 bp, Homo sapiens
aggtgctcccgttctggggcc

SEQ ID NO: 6299 - DNA, 21 bp, Homo sapiens
tcttcttcaggtctgagaggc

SEQ ID NO: 6300 - DNA, 21 bp, Homo sapiens
acaaggtaatgagtagaatgg

SEQ ID NO: 6301 - DNA, 21 bp, Homo sapiens
cctaaccggctggctgcagac

SEQ ID NO: 6302 - DNA, 21 bp, Homo sapiens
aaggcttctggatcagtcttc

SEQ ID NO: 6303 - DNA, 20 bp, Homo sapiens
aaactgtggcttggggggca

SEQ ID NO: 6304 - DNA, 21 bp, Homo sapiens
ttgcaggctcgggcttggaga

SEQ ID NO: 6305 - DNA, 21 bp, Homo sapiens
ttgtgtagccagtctaccacc

SEQ ID NO: 6306 - DNA, 21 bp, Homo sapiens
gaccaccctgctggccggtga

SEQ ID NO: 6307 - DNA, 21 bp, Homo sapiens
ggctgccttggcatcttcaac

SEQ ID NO: 6308 - DNA, 21 bp, Homo sapiens
gtggcttgagtcctctccccg

SEQ ID NO: 6309 - DNA, 21 bp, Homo sapiens
gctgccttggcatcttcaaca

SEQ ID NO: 6310 - DNA, 21 bp, Homo sapiens
gctatatccagaatcggttgc

SEQ ID NO: 6311 - DNA, 21 bp, Homo sapiens
tcagtgtttcatcctcaggtg

SEQ ID NO: 6312 - DNA, 21 bp, Homo sapiens
ctgccttggcatcttcaacat

SEQ ID NO: 6313 - DNA, 21 bp, Homo sapiens
ctccctgtgtgtcttagccgc

SEQ ID NO: 6314 - DNA, 21 bp, Homo sapiens
cagacactgtgagaacaagca

SEQ ID NO: 6315 - DNA, 21 bp, Homo sapiens
gacactgtgagaacaagcagc

SEQ ID NO: 6316 - DNA, 21 bp, Homo sapiens
atttgcgtacgcacgtgcgca

SEQ ID NO: 6317 - DNA, 21 bp, Homo sapiens
gagcaccaagtgttgctgcag

SEQ ID NO: 6318 - DNA, 21 bp, Homo sapiens
attcgatatctatgacccctt

SEQ ID NO: 6319 - DNA, 21 bp, Homo sapiens
cgcctctatcgcctggagggc

SEQ ID NO: 6320 - DNA, 21 bp, Homo sapiens
tgactgagcccgtgtcctgcg

SEQ ID NO: 6321 - DNA, 21 bp, Homo sapiens
tcactctaccgaaagatgaga

SEQ ID NO: 6322 - DNA, 22 bp, Homo sapiens
cagagacctcgtccgccgctgc

SEQ ID NO: 6323 - DNA, 21 bp, Homo sapiens
aagaccagtcgtccaagacgg

SEQ ID NO: 6324 - DNA, 21 bp, Homo sapiens
gagtctaagcatgcacccggt

SEQ ID NO: 6325 - DNA, 21 bp, Homo sapiens
tcacacagacaagagaaggaa

SEQ ID NO: 6326 - DNA, 21 bp, Homo sapiens
tcttctagctcctaagatatg

SEQ ID NO: 6327 - DNA, 21 bp, Homo sapiens
gtcttctagctcctaagatat

SEQ ID NO: 6328 - DNA, 21 bp, Homo sapiens
caactattttccagaaatgga

SEQ ID NO: 6329 - DNA, 21 bp, Homo sapiens
acaactattttccagaaatgg

SEQ ID NO: 6330 - DNA, 21 bp, Homo sapiens
actattttccagaaatggaaa

SEQ ID NO: 6331 - DNA, 21 bp, Homo sapiens
gtgtcttctagctcctaagat

SEQ ID NO: 6332 - DNA, 21 bp, Homo sapiens
catggagcccaacgagatgat

SEQ ID NO: 6333 - DNA, 21 bp, Homo sapiens
gcaaggctgctcgccgaagtg

SEQ ID NO: 6334 - DNA, 21 bp, Homo sapiens
agctttggtgccacctgcgtg

SEQ ID NO: 6335 - DNA, 23 bp, Homo sapiens
cagaggctggagtggtggaaagt

SEQ ID NO: 6336 - DNA, 22 bp, Homo sapiens
ggactcccactgctgccactct

SEQ ID NO: 6337 - DNA, 21 bp, Homo sapiens
gagcgtgctctctattactgg

SEQ ID NO: 6338 - DNA, 21 bp, Homo sapiens
ccagccccttggtgcacagct

SEQ ID NO: 6339 - DNA, 21 bp, Homo sapiens
agcgtgctctctattactgga

SEQ ID NO: 6340 - DNA, 21 bp, Homo sapiens
atcttctgtgtggcagtcttc

SEQ ID NO: 6341 - DNA, 21 bp, Homo sapiens
tcttgaagggccacacaatag

SEQ ID NO: 6342 - DNA, 21 bp, Homo sapiens
ggtggtgcaaagtgttccagg

SEQ ID NO: 6343 - DNA, 21 bp, Homo sapiens
cttcccatccttccttaaggc

SEQ ID NO: 6344 - DNA, 21 bp, Homo sapiens
aggtcatggtcaacgtcctcg

SEQ ID NO: 6345 - DNA, 21 bp, Homo sapiens
aggcatggcttgggtgtcaac

SEQ ID NO: 6346 - DNA, 21 bp, Homo sapiens
gcaccacgcaggacatccaca

SEQ ID NO: 6347 - DNA, 21 bp, Homo sapiens
gcatagctgctacccgccggt

SEQ ID NO: 6348 - DNA, 21 bp, Homo sapiens
tgatccagctggtgtgggagg

SEQ ID NO: 6349 - DNA, 21 bp, Homo sapiens
gatccagctggtgtgggagga

SEQ ID NO: 6350 - DNA, 21 bp, Homo sapiens
ccaaaagctgcaatataagga

SEQ ID NO: 6351 - DNA, 21 bp, Homo sapiens
cagctgcaggcggtgcatggt

SEQ ID NO: 6352 - DNA, 21 bp, Homo sapiens
gggcgggtaggagtcgtccac

SEQ ID NO: 6353 - DNA, 21 bp, Homo sapiens
agcaaagaggtatatggtagg

SEQ ID NO: 6354 - DNA, 20 bp, Homo sapiens
ttcattggctggaaagaaat

SEQ ID NO: 6355 - DNA, 21 bp, Homo sapiens
tcatttgggacatcccttcca

SEQ ID NO: 6356 - DNA, 21 bp, Homo sapiens
ccttcacaaggttctggtacc

SEQ ID NO: 6357 - DNA, 21 bp, Homo sapiens
gccggtaatgccctcatggat

SEQ ID NO: 6358 - DNA, 21 bp, Homo sapiens
attaccttttcgccaatgctt

SEQ ID NO: 6359 - DNA, 21 bp, Homo sapiens
acaacaaggccttcaatgagg

SEQ ID NO: 6360 - DNA, 21 bp, Homo sapiens
tgaggaggatatccgtgttca

SEQ ID NO: 6361 - DNA, 21 bp, Homo sapiens
atgaggaggatatccgtgttc

SEQ ID NO: 6362 - DNA, 21 bp, Homo sapiens
atgtagctcagcatgatgccc

SEQ ID NO: 6363 - DNA, 21 bp, Homo sapiens
ggctgcctactttggcaagat

SEQ ID NO: 6364 - DNA, 21 bp, Homo sapiens
ctgaccgcttgtatgtctaca

SEQ ID NO: 6365 - DNA, 21 bp, Homo sapiens
tgagatttcgtcacaggtact

SEQ ID NO: 6366 - DNA, 21 bp, Homo sapiens
tcagaaatgggtacaagttcc

SEQ ID NO: 6367 - DNA, 21 bp, Homo sapiens
aactcagcatcatcactgggt

SEQ ID NO: 6368 - DNA, 23 bp, Homo sapiens
ctctccagcagccaagccggtcg

SEQ ID NO: 6369 - DNA, 21 bp, Homo sapiens
atattctcatccaaatgattt

SEQ ID NO: 6370 - DNA, 21 bp, Homo sapiens
gttttgaaaggaataatcaca

SEQ ID NO: 6371 - DNA, 21 bp, Homo sapiens
caatacttgatgtaagtattt

SEQ ID NO: 6372 - DNA, 21 bp, Homo sapiens
cttgaaaccaggaactggccc

SEQ ID NO: 6373 - DNA, 21 bp, Homo sapiens
tggaggaagacgtggtcttgg

SEQ ID NO: 6374 - DNA, 21 bp, Homo sapiens
ccagcagggacgacaggcaat

SEQ ID NO: 6375 - DNA, 21 bp, Homo sapiens
cttggccacccccagcgccct

SEQ ID NO: 6376 - DNA, 21 bp, Homo sapiens
agtaacattcgcaaaataatg

SEQ ID NO: 6377 - DNA, 21 bp, Homo sapiens
ctccacagtgcgcaggaccat

SEQ ID NO: 6378 - DNA, 21 bp, Homo sapiens
ttttgaactacttggtagtct

SEQ ID NO: 6379 - DNA, 21 bp, Homo sapiens
gagacatgatctcctttattt

SEQ ID NO: 6380 - DNA, 21 bp, Homo sapiens
ccagctcctactacagccacg

SEQ ID NO: 6381 - DNA, 23 bp, Homo sapiens
gagccaccacaggccccgccagt

SEQ ID NO: 6382 - DNA, 21 bp, Homo sapiens
attatgaaaagcgtccaacag

SEQ ID NO: 6383 - DNA, 21 bp, Homo sapiens
cagctgctgcgccccggcccc

SEQ ID NO: 6384 - DNA, 21 bp, Homo sapiens
ccaggcgcgccgtcagctggg

SEQ ID NO: 6385 - DNA, 22 bp, Homo sapiens
ccagagcgccagcagccacagg

SEQ ID NO: 6386 - DNA, 21 bp, Homo sapiens
ttcttccagacgaccgccatg

SEQ ID NO: 6387 - DNA, 21 bp, Homo sapiens
tgaaaattcacggtgccattc

SEQ ID NO: 6388 - DNA, 21 bp, Homo sapiens
gcaccagggccccaccctcta

SEQ ID NO: 6389 - DNA, 21 bp, Homo sapiens
gttaagtagcgcagccagcag

SEQ ID NO: 6390 - DNA, 21 bp, Homo sapiens
ccagtggctcgccaatccggg

SEQ ID NO: 6391 - DNA, 21 bp, Homo sapiens
tcctcctcttcttctcattcc

SEQ ID NO: 6392 - DNA, 21 bp, Homo sapiens
gagggagctcacctgccagtc

SEQ ID NO: 6393 - DNA, 20 bp, Homo sapiens
ataaatcggcggttacattc

SEQ ID NO: 6394 - DNA, 21 bp, Homo sapiens
gtctctccagcctttgaagat

SEQ ID NO: 6395 - DNA, 23 bp, Homo sapiens
gtacggcaggctcggacacagcg

SEQ ID NO: 6396 - DNA, 21 bp, Homo sapiens
cggagggaccggggcagaaac

SEQ ID NO: 6397 - DNA, 21 bp, Homo sapiens
caggatgacattgaaggtgat

SEQ ID NO: 6398 - DNA, 20 bp, Homo sapiens
acttacaggagggccagggg

SEQ ID NO: 6399 - DNA, 21 bp, Homo sapiens
ttgagagtctgtccatttgtc

SEQ ID NO: 6400 - DNA, 21 bp, Homo sapiens
atgaaggccgcggagtcgggg

SEQ ID NO: 6401 - DNA, 21 bp, Homo sapiens
gatgggcctccggttcatgcc

SEQ ID NO: 6402 - DNA, 21 bp, Homo sapiens
atttgcacaacctataaaatc

SEQ ID NO: 6403 - DNA, 21 bp, Homo sapiens
gctgaagctgtctatggagga

SEQ ID NO: 6404 - DNA, 21 bp, Homo sapiens
ggatgccggcctcgtgcacgt

SEQ ID NO: 6405 - DNA, 21 bp, Homo sapiens
gatgagaaatactatggaagt

SEQ ID NO: 6406 - DNA, 21 bp, Homo sapiens
ctgccgcccgcgcctttcagg

SEQ ID NO: 6407 - DNA, 21 bp, Homo sapiens
ctactcggccaccctgccact

SEQ ID NO: 6408 - DNA, 21 bp, Homo sapiens
aggcgccagacgtgaatctcg

SEQ ID NO: 6409 - DNA, 21 bp, Homo sapiens
tgtgccactccgagtaagtgt

SEQ ID NO: 6410 - DNA, 21 bp, Homo sapiens
gccaccccccgaaaaactgga

SEQ ID NO: 6411 - DNA, 21 bp, Homo sapiens
caaagagaagccacacttgtc

SEQ ID NO: 6412 - DNA, 21 bp, Homo sapiens
ggtccatgcccgagctcggac

SEQ ID NO: 6413 - DNA, 21 bp, Homo sapiens
atttgagaagataacaaagcc

SEQ ID NO: 6414 - DNA, 21 bp, Homo sapiens
taagagaccaacagaatccaa

SEQ ID NO: 6415 - DNA, 21 bp, Homo sapiens
gcgtaggatgcgccagattaa

SEQ ID NO: 6416 - DNA, 21 bp, Homo sapiens
cagcggacctctggggcctct

SEQ ID NO: 6417 - DNA, 21 bp, Homo sapiens
ctgcacataccgtgttattac

SEQ ID NO: 6418 - DNA, 21 bp, Homo sapiens
ctaatcatgtaagtaaggcaa

SEQ ID NO: 6419 - DNA, 21 bp, Homo sapiens
gaacctggcacagatcttcct

SEQ ID NO: 6420 - DNA, 21 bp, Homo sapiens
gccagactcacttctgagaag

SEQ ID NO: 6421 - DNA, 21 bp, Homo sapiens
catgggggcaggcactgcagc

SEQ ID NO: 6422 - DNA, 21 bp, Homo sapiens
gagggcgcgccaggccggccc

SEQ ID NO: 6423 - DNA, 21 bp, Homo sapiens
ttctttgcctgtctggtccag

SEQ ID NO: 6424 - DNA, 22 bp, Homo sapiens
agagaggctagtatacgctgct

SEQ ID NO: 6425 - DNA, 21 bp, Homo sapiens
tgcacggcaaatgagagctcc

SEQ ID NO: 6426 - DNA, 21 bp, Homo sapiens
tacagcatctgatatccgaga

SEQ ID NO: 6427 - DNA, 21 bp, Homo sapiens
gtacagcatctgatatccgag

SEQ ID NO: 6428 - DNA, 20 bp, Homo sapiens
ggcaccggctggtagccgtt

SEQ ID NO: 6429 - DNA, 21 bp, Homo sapiens
gcactggtgctccgcttcctg

SEQ ID NO: 6430 - DNA, 22 bp, Homo sapiens
tgtggcagggcagcgcgcagtt

SEQ ID NO: 6431 - DNA, 21 bp, Homo sapiens
attcccgggacgcaaagtaat

SEQ ID NO: 6432 - DNA, 21 bp, Homo sapiens
ccgggccagctccagccgcac

SEQ ID NO: 6433 - DNA, 21 bp, Homo sapiens
tgccatttcttctgtaacagt

SEQ ID NO: 6434 - DNA, 21 bp, Homo sapiens
gggccaggcagagcactggaa

SEQ ID NO: 6435 - DNA, 21 bp, Homo sapiens
caagatcaaggtgtgtgtttt

SEQ ID NO: 6436 - DNA, 21 bp, Homo sapiens
acatgtactcgtcgtagagca

SEQ ID NO: 6437 - DNA, 21 bp, Homo sapiens
ttcgggaggcgtccctgagca

SEQ ID NO: 6438 - DNA, 21 bp, Homo sapiens
gatcccctaacgtgtggctga

SEQ ID NO: 6439 - DNA, 21 bp, Homo sapiens
ggagagaatcgcctggctact

SEQ ID NO: 6440 - DNA, 21 bp, Homo sapiens
agcagcaatccaaaccgtatg

SEQ ID NO: 6441 - DNA, 21 bp, Homo sapiens
gcacagaagcaggagcccagg

SEQ ID NO: 6442 - DNA, 23 bp, Homo sapiens
ctactggcttggctgatgttact

SEQ ID NO: 6443 - DNA, 23 bp, Homo sapiens
acccaggaccgaacctgccgctg

SEQ ID NO: 6444 - DNA, 21 bp, Homo sapiens
gaaaaagtctatcagaaccat

SEQ ID NO: 6445 - DNA, 21 bp, Homo sapiens
tttctacgtggtgcagctgct

SEQ ID NO: 6446 - DNA, 21 bp, Homo sapiens
tacttgctagtagtcttttac

SEQ ID NO: 6447 - DNA, 21 bp, Homo sapiens
gctggagcatgtgtcccgcga

SEQ ID NO: 6448 - DNA, 22 bp, Homo sapiens
ccatcggcggccggaatgagaa

SEQ ID NO: 6449 - DNA, 21 bp, Homo sapiens
gagttcatcgattggtggagc

SEQ ID NO: 6450 - DNA, 23 bp, Homo sapiens
cgaggacagctggccgccgatat

SEQ ID NO: 6451 - DNA, 22 bp, Homo sapiens
ccacacccgcgacccgccgcac

SEQ ID NO: 6452 - DNA, 21 bp, Homo sapiens
gggcggatccgactacaacta

SEQ ID NO: 6453 - DNA, 21 bp, Homo sapiens
ggaatatcaccattcacctaa

SEQ ID NO: 6454 - DNA, 21 bp, Homo sapiens
gtgcaccacccgcaccaagac

SEQ ID NO: 6455 - DNA, 21 bp, Homo sapiens
ctccaaccggatttgggtaat

SEQ ID NO: 6456 - DNA, 21 bp, Homo sapiens
cagctgcagctgctactttaa

SEQ ID NO: 6457 - DNA, 21 bp, Homo sapiens
tgctgccaggcggcctgtgag

SEQ ID NO: 6458 - DNA, 21 bp, Homo sapiens
ataaaaacatcctgccctgta

SEQ ID NO: 6459 - DNA, 21 bp, Homo sapiens
tttccccaaacgactgaacct

SEQ ID NO: 6460 - DNA, 21 bp, Homo sapiens
tccagccccccgagaaggaga

SEQ ID NO: 6461 - DNA, 21 bp, Homo sapiens
ggccaggatgaaggattctgt

SEQ ID NO: 6462 - DNA, 21 bp, Homo sapiens
aggaggccaacgtggggaaaa

SEQ ID NO: 6463 - DNA, 21 bp, Homo sapiens
tggacagcaacgagctgacct

SEQ ID NO: 6464 - DNA, 21 bp, Homo sapiens
cgctaaggacgacagcgagaa

SEQ ID NO: 6465 - DNA, 21 bp, Homo sapiens
tcataacacacgataagtctt

SEQ ID NO: 6466 - DNA, 21 bp, Homo sapiens
cccttggcggaagccctgctc

SEQ ID NO: 6467 - DNA, 21 bp, Homo sapiens
gcggccgcgacgaaaggcgca

SEQ ID NO: 6468 - DNA, 21 bp, Homo sapiens
aagaactgaaagaaaaagcaa

SEQ ID NO: 6469 - DNA, 21 bp, Homo sapiens
tcacagaaaggaagaggtcct

SEQ ID NO: 6470 - DNA, 21 bp, Homo sapiens
cccagaagggcggactggccg

SEQ ID NO: 6471 - DNA, 21 bp, Homo sapiens
ttcgttatgggaagaaggatt

SEQ ID NO: 6472 - DNA, 23 bp, Homo sapiens
atctcgagcctctccagccactc

SEQ ID NO: 6473 - DNA, 21 bp, Homo sapiens
ccctacgtctgccccgactgc

SEQ ID NO: 6474 - DNA, 20 bp, Homo sapiens
gattgtggctggagtgccct

SEQ ID NO: 6475 - DNA, 21 bp, Homo sapiens
agagaatatcgtgtccaagat

SEQ ID NO: 6476 - DNA, 21 bp, Homo sapiens
tctgaaaattgttgaggaggc

SEQ ID NO: 6477 - DNA, 23 bp, Homo sapiens
tggagctcacacaacaacaatta

SEQ ID NO: 6478 - DNA, 21 bp, Homo sapiens
cggcagcgccgccaacgggcg

SEQ ID NO: 6479 - DNA, 21 bp, Homo sapiens
taattatccaacagccactgg

SEQ ID NO: 6480 - DNA, 20 bp, Homo sapiens
gctaccggctgttgaagatg

SEQ ID NO: 6481 - DNA, 21 bp, Homo sapiens
cacaaagaaacgtgcatggcc

SEQ ID NO: 6482 - DNA, 21 bp, Homo sapiens
cctcaggggaagagtcagtcg

SEQ ID NO: 6483 - DNA, 21 bp, Homo sapiens
aaccactttcgtcgactgtta

SEQ ID NO: 6484 - DNA, 23 bp, Homo sapiens
ctatggcgggcaagctctgagct

SEQ ID NO: 6485 - DNA, 22 bp, Homo sapiens
gcagcggcagctgtgccagcgt

SEQ ID NO: 6486 - DNA, 21 bp, Homo sapiens
tttccgaactctggtggggga

SEQ ID NO: 6487 - DNA, 21 bp, Homo sapiens
cttctagggcactgcatcaga

SEQ ID NO: 6488 - DNA, 21 bp, Homo sapiens
atgtgacctgcgcccgggatg

SEQ ID NO: 6489 - DNA, 21 bp, Homo sapiens
cgagctgtccggtcataggag

SEQ ID NO: 6490 - DNA, 23 bp, Homo sapiens
ggcatttttcttgccgccgctcc

SEQ ID NO: 6491 - DNA, 21 bp, Homo sapiens
ggaacgtttggaaattgctag

SEQ ID NO: 6492 - DNA, 21 bp, Homo sapiens
ataggtccccgtcagcttcag

SEQ ID NO: 6493 - DNA, 22 bp, Homo sapiens
cctggagtgagcaagcctctcc

SEQ ID NO: 6494 - DNA, 21 bp, Homo sapiens
gaaactttcattagtctggaa

SEQ ID NO: 6495 - DNA, 21 bp, Homo sapiens
gagcccagttcggaatggtta

SEQ ID NO: 6496 - DNA, 21 bp, Homo sapiens
ttccgggacgaggagctgtcc

SEQ ID NO: 6497 - DNA, 22 bp, Homo sapiens
ggactggcagctgccgtcccac

SEQ ID NO: 6498 - DNA, 21 bp, Homo sapiens
ttgatgcccacgtggaattca

SEQ ID NO: 6499 - DNA, 21 bp, Homo sapiens
ctagatcatgccagccagcca

SEQ ID NO: 6500 - DNA, 21 bp, Homo sapiens
ggctatagttcgccatagatg

SEQ ID NO: 6501 - DNA, 21 bp, Homo sapiens
tcactcgccccgtcaatgtca

SEQ ID NO: 6502 - DNA, 21 bp, Homo sapiens
caccttagaacgatgttttac

SEQ ID NO: 6503 - DNA, 22 bp, Homo sapiens
ttagtggcggctgccacaaagc

SEQ ID NO: 6504 - DNA, 21 bp, Homo sapiens
attgttatggaaatgctgctg

SEQ ID NO: 6505 - DNA, 22 bp, Homo sapiens
gagaggctggcaggccaccaca

SEQ ID NO: 6506 - DNA, 21 bp, Homo sapiens
aaagtccatccgtaagtccct

SEQ ID NO: 6507 - DNA, 21 bp, Homo sapiens
aaattgcaaccgcagataagt

SEQ ID NO: 6508 - DNA, 21 bp, Homo sapiens
tgtcgacctagaccataagtt

SEQ ID NO: 6509 - DNA, 21 bp, Homo sapiens
tcattaaattcctctaacaaa

SEQ ID NO: 6510 - DNA, 21 bp, Homo sapiens
cggcggcagcgataccagatg

SEQ ID NO: 6511 - DNA, 22 bp, Homo sapiens
tcagggctccagccccctgcca

SEQ ID NO: 6512 - DNA, 21 bp, Homo sapiens
cctctattggctggaaaatta

SEQ ID NO: 6513 - DNA, 21 bp, Homo sapiens
tcaactcaccttgaaatctcg

SEQ ID NO: 6514 - DNA, 21 bp, Homo sapiens
caccagagcccgagaattaaa

SEQ ID NO: 6515 - DNA, 22 bp, Homo sapiens
cacgcaggagccgagccaggtc

SEQ ID NO: 6516 - DNA, 21 bp, Homo sapiens
gctgggccttgacatgttgac

SEQ ID NO: 6517 - DNA, 21 bp, Homo sapiens
gcctgagtccccaggtaccct

SEQ ID NO: 6518 - DNA, 22 bp, Homo sapiens
tgcctcccccagcagccgctcc

SEQ ID NO: 6519 - DNA, 21 bp, Homo sapiens
tccgtgtgttcgtaggcggcc

SEQ ID NO: 6520 - DNA, 21 bp, Homo sapiens
cgatggccacgtagcggtcaa

SEQ ID NO: 6521 - DNA, 21 bp, Homo sapiens
ccagaatttccaggtttacat

SEQ ID NO: 6522 - DNA, 20 bp, Homo sapiens
gggtatggcaggcccgtgcc

SEQ ID NO: 6523 - DNA, 22 bp, Homo sapiens
cagactgtacagcagccacagt

SEQ ID NO: 6524 - DNA, 21 bp, Homo sapiens
tgccaggcagcgatcacagcg

SEQ ID NO: 6525 - DNA, 21 bp, Homo sapiens
cgtcagccccgccctgccgct

SEQ ID NO: 6526 - DNA, 22 bp, Homo sapiens
tatcggctggatgattctgata

SEQ ID NO: 6527 - DNA, 21 bp, Homo sapiens
ccggcgggccacgccagccac

SEQ ID NO: 6528 - DNA, 23 bp, Homo sapiens
aatcagtttctttcccgccacga

SEQ ID NO: 6529 - DNA, 23 bp, Homo sapiens
aattccgcggcccgagccgatgc

SEQ ID NO: 6530 - DNA, 21 bp, Homo sapiens
tgccagtctcgtggcagaaca

SEQ ID NO: 6531 - DNA, 23 bp, Homo sapiens
gtctccatcctctccagccacac

SEQ ID NO: 6532 - DNA, 21 bp, Homo sapiens
acccagtctttggctgaacca

SEQ ID NO: 6533 - DNA, 21 bp, Homo sapiens
tctttgcagttgccttgccaa

SEQ ID NO: 6534 - DNA, 23 bp, Homo sapiens
gatcggcgggtcagccccacctg

SEQ ID NO: 6535 - DNA, 21 bp, Homo sapiens
tcgggcccacgctgcttcggc

SEQ ID NO: 6536 - DNA, 23 bp, Homo sapiens
gaccatcagaggcaagccagtag

SEQ ID NO: 6537 - DNA, 21 bp, Homo sapiens
actaacctttgacccggacgt

SEQ ID NO: 6538 - DNA, 21 bp, Homo sapiens
agggcagtgacgccgtgaaat

SEQ ID NO: 6539 - DNA, 21 bp, Homo sapiens
ttacatggggcgcagatccct

SEQ ID NO: 6540 - DNA, 20 bp, Homo sapiens
ggatgtggctggccagtctt

SEQ ID NO: 6541 - DNA, 22 bp, Homo sapiens
cgaagccggctgcagccactcc

SEQ ID NO: 6542 - DNA, 21 bp, Homo sapiens
gaccacgggggcagccacagc

SEQ ID NO: 6543 - DNA, 21 bp, Homo sapiens
taatctgcatgtcatcctaga

SEQ ID NO: 6544 - DNA, 21 bp, Homo sapiens
ttttgctcttgagttcttgat

SEQ ID NO: 6545 - DNA, 21 bp, Homo sapiens
ccttttttggcgttaaatgat

SEQ ID NO: 6546 - DNA, 21 bp, Homo sapiens
aaggtgcagagacccctgtgt

SEQ ID NO: 6547 - DNA, 21 bp, Homo sapiens
ggggaggaatgccggccagga

SEQ ID NO: 6548 - DNA, 22 bp, Homo sapiens
cgagtggctgccgcccatgctg

SEQ ID NO: 6549 - DNA, 21 bp, Homo sapiens
tgtggctgtcgtggctgctct

SEQ ID NO: 6550 - DNA, 21 bp, Homo sapiens
ctcggcagtgggggactcttg

SEQ ID NO: 6551 - DNA, 21 bp, Homo sapiens
tggcagctgctcctgccactc

SEQ ID NO: 6552 - DNA, 20 bp, Homo sapiens
ttcttgtggcggttgagctt

SEQ ID NO: 6553 - DNA, 21 bp, Homo sapiens
gagttgaatacaaccacatca

SEQ ID NO: 6554 - DNA, 21 bp, Homo sapiens
ggatctggccgttggccagca

SEQ ID NO: 6555 - DNA, 21 bp, Homo sapiens
tccacagctaccgaggtacgg

SEQ ID NO: 6556 - DNA, 21 bp, Homo sapiens
gagaccatgacgatttcaata

SEQ ID NO: 6557 - DNA, 21 bp, Homo sapiens
taacaactaccatggtggcca

SEQ ID NO: 6558 - DNA, 21 bp, Homo sapiens
caccacctgagatataaaaaa

SEQ ID NO: 6559 - DNA, 21 bp, Homo sapiens
caagagcccacgccacacagt

SEQ ID NO: 6560 - DNA, 21 bp, Homo sapiens
ctttgcattcgtcttctctgc

SEQ ID NO: 6561 - DNA, 23 bp, Homo sapiens
cagtggctgggctggaggctgga

SEQ ID NO: 6562 - DNA, 23 bp, Homo sapiens
tcaacataacgtaccccagccac

SEQ ID NO: 6563 - DNA, 21 bp, Homo sapiens
aagacacacagcatccatgca

SEQ ID NO: 6564 - DNA, 21 bp, Homo sapiens
cctcccaggcgtcgtggcagc

SEQ ID NO: 6565 - DNA, 22 bp, Homo sapiens
gctgcggctgcagggctccagc

SEQ ID NO: 6566 - DNA, 21 bp, Homo sapiens
acatgtataaattccactcat

SEQ ID NO: 6567 - DNA, 21 bp, Homo sapiens
acttgcggcgtggggagtccc

SEQ ID NO: 6568 - DNA, 21 bp, Homo sapiens
tattcattactcttcctccat

SEQ ID NO: 6569 - DNA, 21 bp, Homo sapiens
acatcttctcatacactgcct

SEQ ID NO: 6570 - DNA, 21 bp, Homo sapiens
tgcaggtagtcctccatgttc

SEQ ID NO: 6571 - DNA, 21 bp, Homo sapiens
ctgggagaggcggacgatgac

SEQ ID NO: 6572 - DNA, 20 bp, Homo sapiens
ggcagtggctgttgactcag

SEQ ID NO: 6573 - DNA, 20 bp, Homo sapiens
cgatattggcttggggtctg

SEQ ID NO: 6574 - DNA, 21 bp, Homo sapiens
gcgcctgccacatgccgtcca

SEQ ID NO: 6575 - DNA, 21 bp, Homo sapiens
gcctcgcttattcatctcggt

SEQ ID NO: 6576 - DNA, 21 bp, Homo sapiens
gggagtataaaggtttaaaat

SEQ ID NO: 6577 - DNA, 21 bp, Homo sapiens
gatgaagatacgctatatgag

SEQ ID NO: 6578 - DNA, 21 bp, Homo sapiens
tactattatcctaatttcctt

SEQ ID NO: 6579 - DNA, 21 bp, Homo sapiens
accaaaggctctgcaaatgac

SEQ ID NO: 6580 - DNA, 21 bp, Homo sapiens
caggctgccaacaacgtgcga

SEQ ID NO: 6581 - DNA, 21 bp, Homo sapiens
ctctcccccggtggggtggaa

SEQ ID NO: 6582 - DNA, 21 bp, Homo sapiens
gcatctctgtttctgagtgac

SEQ ID NO: 6583 - DNA, 21 bp, Homo sapiens
catctctgtttctgagtgaca

SEQ ID NO: 6584 - DNA, 21 bp, Homo sapiens
cccctcaccacctccctgttc

SEQ ID NO: 6585 - DNA, 21 bp, Homo sapiens
agatggggagatgttcatgcg

SEQ ID NO: 6586 - DNA, 21 bp, Homo sapiens
cttttggaagcgtaggacctt

SEQ ID NO: 6587 - DNA, 21 bp, Homo sapiens
gacccttccacgggctgctac

SEQ ID NO: 6588 - DNA, 21 bp, Homo sapiens
ccaacctcatgtttgccttct

SEQ ID NO: 6589 - DNA, 21 bp, Homo sapiens
gttgcagtccacttccacagt

SEQ ID NO: 6590 - DNA, 21 bp, Homo sapiens
accaacctcatgtttgccttc

SEQ ID NO: 6591 - DNA, 21 bp, Homo sapiens
cgaacaagaaagggtagttgc

SEQ ID NO: 6592 - DNA, 21 bp, Homo sapiens
ccgaacaagaaagggtagttg

SEQ ID NO: 6593 - DNA, 21 bp, Homo sapiens
ttctcctgctccccttcactg

SEQ ID NO: 6594 - DNA, 21 bp, Homo sapiens
gtcaagcaggtaggagaggtc

SEQ ID NO: 6595 - DNA, 21 bp, Homo sapiens
tcaagcaggtaggagaggtcc

SEQ ID NO: 6596 - DNA, 21 bp, Homo sapiens
ttcgtggtgtgctggttcccc

SEQ ID NO: 6597 - DNA, 21 bp, Homo sapiens
tcatacagctcgtccaaaggc

SEQ ID NO: 6598 - DNA, 21 bp, Homo sapiens
gcctctgcgccgcatgctgcc

SEQ ID NO: 6599 - DNA, 21 bp, Homo sapiens
cttcttcaggtctgagaggca

SEQ ID NO: 6600 - DNA, 21 bp, Homo sapiens
ccaccattatggggaccggcg

SEQ ID NO: 6601 - DNA, 21 bp, Homo sapiens
cgcaaagccacgagtatctgt

SEQ ID NO: 6602 - DNA, 21 bp, Homo sapiens
ctaaccggctggctgcagacc

SEQ ID NO: 6603 - DNA, 21 bp, Homo sapiens
cggcctcaggggtggctccca

SEQ ID NO: 6604 - DNA, 21 bp, Homo sapiens
gacttgaacagcacctgccaa

SEQ ID NO: 6605 - DNA, 23 bp, Homo sapiens
ccggcggcggtgcgggcccgcag

SEQ ID NO: 6606 - DNA, 21 bp, Homo sapiens
agctttgcttggaacattaca

SEQ ID NO: 6607 - DNA, 21 bp, Homo sapiens
agccataccattgatactcca

SEQ ID NO: 6608 - DNA, 21 bp, Homo sapiens
accaccctgctggccggtgac

SEQ ID NO: 6609 - DNA, 21 bp, Homo sapiens
atagtttgggccaccaccaac

SEQ ID NO: 6610 - DNA, 21 bp, Homo sapiens
gccataccattgatactccac

SEQ ID NO: 6611 - DNA, 21 bp, Homo sapiens
cagtgtttcatcctcaggtga

SEQ ID NO: 6612 - DNA, 21 bp, Homo sapiens
cgtaggatgaggagaagcccg

SEQ ID NO: 6613 - DNA, 21 bp, Homo sapiens
ttggcggctagttccactgcc

SEQ ID NO: 6614 - DNA, 21 bp, Homo sapiens
agacactgtgagaacaagcag

SEQ ID NO: 6615 - DNA, 21 bp, Homo sapiens
tcgtaggatgaggagaagccc

SEQ ID NO: 6616 - DNA, 21 bp, Homo sapiens
ccgctgtggggactgtggccg

SEQ ID NO: 6617 - DNA, 21 bp, Homo sapiens
tcgctggaaatgcagtggttc

SEQ ID NO: 6618 - DNA, 21 bp, Homo sapiens
ttgggcaggctgaccacctgg

SEQ ID NO: 6619 - DNA, 21 bp, Homo sapiens
ggccctgcgcaaccacgtgcg

SEQ ID NO: 6620 - DNA, 21 bp, Homo sapiens
ggctgttgaggggcgtcttcc

SEQ ID NO: 6621 - DNA, 21 bp, Homo sapiens
gcagtagaccgacctggacac

SEQ ID NO: 6622 - DNA, 21 bp, Homo sapiens
agaagaggcgcgggcgtccca

SEQ ID NO: 6623 - DNA, 21 bp, Homo sapiens
aggtcctggacgccatgcccc

SEQ ID NO: 6624 - DNA, 21 bp, Homo sapiens
gaaacttttcggggaaaggtt

SEQ ID NO: 6625 - DNA, 22 bp, Homo sapiens
atagcacacaggttggtgtcct

SEQ ID NO: 6626 - DNA, 21 bp, Homo sapiens
cacacaggttggtgtcctcaa

SEQ ID NO: 6627 - DNA, 21 bp, Homo sapiens
ccctcctggcgtccccctgca

SEQ ID NO: 6628 - DNA, 21 bp, Homo sapiens
caacattaaggagtacaaaga

SEQ ID NO: 6629 - DNA, 21 bp, Homo sapiens
aaataaccaacctggaagtga

SEQ ID NO: 6630 - DNA, 21 bp, Homo sapiens
cctacctgaaggatgtatcct

SEQ ID NO: 6631 - DNA, 21 bp, Homo sapiens
ccctacctgaaggatgtatcc

SEQ ID NO: 6632 - DNA, 21 bp, Homo sapiens
cggtgccaaactgcgagaagt

SEQ ID NO: 6633 - DNA, 21 bp, Homo sapiens
cctgccagcacgattcaaagt

SEQ ID NO: 6634 - DNA, 21 bp, Homo sapiens
ggaatctggcatgaaggacat

SEQ ID NO: 6635 - DNA, 21 bp, Homo sapiens
tagtgttagcggggaggctgg

SEQ ID NO: 6636 - DNA, 22 bp, Homo sapiens
aaagtggctgtcgtagtattaa

SEQ ID NO: 6637 - DNA, 21 bp, Homo sapiens
agagcgtgctctctattactg

SEQ ID NO: 6638 - DNA, 21 bp, Homo sapiens
ggggattatcgtcctcattta

SEQ ID NO: 6639 - DNA, 21 bp, Homo sapiens
catgggtgagtccttgggaca

SEQ ID NO: 6640 - DNA, 21 bp, Homo sapiens
ggacaaattcttgtaacttca

SEQ ID NO: 6641 - DNA, 21 bp, Homo sapiens
ggcaacgacgagaagaagatg

SEQ ID NO: 6642 - DNA, 21 bp, Homo sapiens
tcaacccagcggccttgctgc

SEQ ID NO: 6643 - DNA, 21 bp, Homo sapiens
ggtcatggtcaacgtcctcgg

SEQ ID NO: 6644 - DNA, 21 bp, Homo sapiens
gtcatggtcaacgtcctcggg

SEQ ID NO: 6645 - DNA, 21 bp, Homo sapiens
attcctggggctctgggccca

SEQ ID NO: 6646 - DNA, 21 bp, Homo sapiens
accacgcaggacatccacagg

SEQ ID NO: 6647 - DNA, 21 bp, Homo sapiens
gtttgagctcccgcatgtagg

SEQ ID NO: 6648 - DNA, 21 bp, Homo sapiens
ggatttcagcgaggctgtgtt

SEQ ID NO: 6649 - DNA, 21 bp, Homo sapiens
gtagtctttctatctcaagct

SEQ ID NO: 6650 - DNA, 21 bp, Homo sapiens
cactcatcagttccttcgtgc

SEQ ID NO: 6651 - DNA, 21 bp, Homo sapiens
tccactcatcagttccttcgt

SEQ ID NO: 6652 - DNA, 21 bp, Homo sapiens
ccactcatcagttccttcgtg

SEQ ID NO: 6653 - DNA, 21 bp, Homo sapiens
tgtcaaggggcggatgtactt

SEQ ID NO: 6654 - DNA, 21 bp, Homo sapiens
cagtcttttcgcaaagtgtat

SEQ ID NO: 6655 - DNA, 21 bp, Homo sapiens
aaactctcctatgaacactcg

SEQ ID NO: 6656 - DNA, 21 bp, Homo sapiens
cagctggcgacgtgccacttt

SEQ ID NO: 6657 - DNA, 21 bp, Homo sapiens
atacggcagcagcacgaggtg

SEQ ID NO: 6658 - DNA, 21 bp, Homo sapiens
gacgtcaacgcgctcaccggc

SEQ ID NO: 6659 - DNA, 21 bp, Homo sapiens
gctccagaggaaagagtagta

SEQ ID NO: 6660 - DNA, 21 bp, Homo sapiens
tggctgcctactttggcaaga

SEQ ID NO: 6661 - DNA, 21 bp, Homo sapiens
tgaccgcttgtatgtctacag

SEQ ID NO: 6662 - DNA, 21 bp, Homo sapiens
agatttcgtcacaggtacttt

SEQ ID NO: 6663 - DNA, 21 bp, Homo sapiens
gagatttcgtcacaggtactt

SEQ ID NO: 6664 - DNA, 21 bp, Homo sapiens
gcaaagcactcaacagccacc

SEQ ID NO: 6665 - DNA, 21 bp, Homo sapiens
tcgcaccctccgacgacgccc

SEQ ID NO: 6666 - DNA, 21 bp, Homo sapiens
gccacctaccgccgcctgctg

SEQ ID NO: 6667 - DNA, 21 bp, Homo sapiens
cacttcccagcgatcgtcaca

SEQ ID NO: 6668 - DNA, 21 bp, Homo sapiens
ctaaagaaacatgtcttagtg

SEQ ID NO: 6669 - DNA, 21 bp, Homo sapiens
caaaggagatccaggggtcat

SEQ ID NO: 6670 - DNA, 21 bp, Homo sapiens
tacagcatctgatatccgaga

SEQ ID NO: 6671 - DNA, 21 bp, Homo sapiens
gtacagcatctgatatccgag

SEQ ID NO: 6672 - DNA, 21 bp, Homo sapiens
ggatgccccacgagacagaag

SEQ ID NO: 6673 - DNA, 21 bp, Homo sapiens
agattagctacgcctctacca

SEQ ID NO: 6674 - DNA, 21 bp, Homo sapiens
tgggggtctcggtctccccac

SEQ ID NO: 6675 - DNA, 21 bp, Homo sapiens
aaacagcggggcaggcggagg

SEQ ID NO: 6676 - DNA, 22 bp, Homo sapiens
gaaacaactctatgtggtgaga

SEQ ID NO: 6677 - DNA, 21 bp, Homo sapiens
gctgggggtgcgagagctgcg

SEQ ID NO: 6678 - DNA, 23 bp, Homo sapiens
ctgagcagcctggcctgccatgt

SEQ ID NO: 6679 - DNA, 23 bp, Homo sapiens
ctaacggcttgacttccgataac

SEQ ID NO: 6680 - DNA, 21 bp, Homo sapiens
gtctcctccacgcacttcatc

SEQ ID NO: 6681 - DNA, 21 bp, Homo sapiens
attctgggcccagaatggcag

SEQ ID NO: 6682 - DNA, 21 bp, Homo sapiens
gcccctcggcgccccgccaag

SEQ ID NO: 6683 - DNA, 20 bp, Homo sapiens
ccaagtggcagctcctggcc

SEQ ID NO: 6684 - DNA, 21 bp, Homo sapiens
tcccaggcccgcgacaagctg

SEQ ID NO: 6685 - DNA, 23 bp, Homo sapiens
tcaacataacgtaccccagccac

SEQ ID NO: 6686 - DNA, 21 bp, Homo sapiens
gctcgccttcctaggcgctga

SEQ ID NO: 6687 - DNA, 22 bp, Homo sapiens
gctggcggggcagcatctacaa

SEQ ID NO: 6688 - DNA, 21 bp, Homo sapiens
tctggtacaaggaaggatagt

SEQ ID NO: 6689 - DNA, 23 bp, Homo sapiens
acactggcttgcctcctcctagc

SEQ ID NO: 6690 - DNA, 21 bp, Homo sapiens
gctgttccgtcccagtagatt

SEQ ID NO: 6691 - DNA, 21 bp, Homo sapiens
tcaccaggaacggcggcaacg

SEQ ID NO: 6692 - DNA, 21 bp, Homo sapiens
atccgccaaacgcagtcagct

SEQ ID NO: 6693 - DNA, 22 bp, Homo sapiens
tcagttgctcagcccgccgttc

SEQ ID NO: 6694 - DNA, 21 bp, Homo sapiens
cgccggggacggcccgcgacc

SEQ ID NO: 6695 - DNA, 21 bp, Homo sapiens
ggttgcggttgttgtccatgg

SEQ ID NO: 6696 - DNA, 23 bp, Homo sapiens
gataggtccccctgctgctgctg

SEQ ID NO: 6697 - DNA, 21 bp, Homo sapiens
ttgcggcgggcggcgtggatg

SEQ ID NO: 6698 - DNA, 21 bp, Homo sapiens
ctctccccagcggccagcgac

SEQ ID NO: 6699 - DNA, 22 bp, Homo sapiens
aacagcggggcaggagccagca

SEQ ID NO: 6700 - DNA, 23 bp, Homo sapiens
atctcgagcctctccagccactc

SEQ ID NO: 6701 - DNA, 21 bp, Homo sapiens
aaaacagaagggcaggaggag

SEQ ID NO: 6702 - DNA, 21 bp, Homo sapiens
gtgggcccgcgcttcccgcat

SEQ ID NO: 6703 - DNA, 21 bp, Homo sapiens
aaggcctcaaccccgtgggtc

SEQ ID NO: 6704 - DNA, 21 bp, Homo sapiens
tggagaaaggcggtctcgccc

SEQ ID NO: 6705 - DNA, 21 bp, Homo sapiens
ttcagacacacggtaagcata

SEQ ID NO: 6706 - DNA, 21 bp, Homo sapiens
ccagcagtacgtgggtcccta

SEQ ID NO: 6707 - DNA, 20 bp, Homo sapiens
ggcagcggctgctcccgata

SEQ ID NO: 6708 - DNA, 21 bp, Homo sapiens
ggaatggcaggctgcccacca

SEQ ID NO: 6709 - DNA, 23 bp, Homo sapiens
tagcagcccccacagccctccca

SEQ ID NO: 6710 - DNA, 20 bp, Homo sapiens
gggtatggcaggcccgtgcc

SEQ ID NO: 6711 - DNA, 21 bp, Homo sapiens
aaagtccccacgaagaggcct

SEQ ID NO: 6712 - DNA, 21 bp, Homo sapiens
gaatcaagcccgtgaacttcc

SEQ ID NO: 6713 - DNA, 22 bp, Homo sapiens
cgagcggcagctgctgctgagc

SEQ ID NO: 6714 - DNA, 21 bp, Homo sapiens
gctcgggccagagcagtgctg

SEQ ID NO: 6715 - DNA, 21 bp, Homo sapiens
aaaaaagacattaaaacttga

SEQ ID NO: 6716 - DNA, 21 bp, Homo sapiens
tcagaaccccgtcctctacag

SEQ ID NO: 6717 - DNA, 21 bp, Homo sapiens
aagcggctggcgggcggcgac

SEQ ID NO: 6718 - DNA, 21 bp, Homo sapiens
agcactccacccccgactcca

SEQ ID NO: 6719 - DNA, 21 bp, Homo sapiens
taccgcatgcgcaagtatggc

SEQ ID NO: 6720 - DNA, 21 bp, Homo sapiens
gtgctcctgccccctgcctga

SEQ ID NO: 6721 - DNA, 22 bp, Homo sapiens
gcaaacactttatgtcaatggt

SEQ ID NO: 6722 - DNA, 21 bp, Homo sapiens
tctaaacctgcgtgtatttga

SEQ ID NO: 6723 - DNA, 22 bp, Homo sapiens
gctgtggctgtcgccgagcctg

SEQ ID NO: 6724 - DNA, 21 bp, Homo sapiens
tacttgctagtagtcttttac

SEQ ID NO: 6725 - DNA, 21 bp, Homo sapiens
gcatcgcacacgtaaacaaaa

SEQ ID NO: 6726 - DNA, 21 bp, Homo sapiens
gctctcagccctacactctcc

SEQ ID NO: 6727 - DNA, 21 bp, Homo sapiens
ggtggcaagagaaggcgcaga

SEQ ID NO: 6728 - DNA, 21 bp, Homo sapiens
cgcccaggtcggacttgcagc

SEQ ID NO: 6729 - DNA, 20 bp, Homo sapiens
ttttttttttagcatcggcg

SEQ ID NO: 6730 - DNA, 21 bp, Homo sapiens
tgggcggggccgagcgcacgg

SEQ ID NO: 6731 - DNA, 21 bp, Homo sapiens
aattgtgggtgggggcttggc

SEQ ID NO: 6732 - DNA, 21 bp, Homo sapiens
ctgtggcggctgcagcctccg

SEQ ID NO: 6733 - DNA, 21 bp, Homo sapiens
gtccaggccctggcacaaaca

SEQ ID NO: 6734 - DNA, 21 bp, Homo sapiens
ccagagcccattggccatgca

SEQ ID NO: 6735 - DNA, 21 bp, Homo sapiens
aaagatagagcgcatcaggtc

SEQ ID NO: 6736 - DNA, 21 bp, Homo sapiens
gaaggtggacgtgtatggctt

SEQ ID NO: 6737 - DNA, 21 bp, Homo sapiens
tcccacaagcacgcctgccac

SEQ ID NO: 6738 - DNA, 21 bp, Homo sapiens
aggaaaaaataaatgaaatgc

SEQ ID NO: 6739 - DNA, 23 bp, Homo sapiens
acccaaatccttgccctgccaat

SEQ ID NO: 6740 - DNA, 21 bp, Homo sapiens
atctggggatgccctgtatgt

SEQ ID NO: 6741 - DNA, 21 bp, Homo sapiens
aggctttgggcggggcggagc

SEQ ID NO: 6742 - DNA, 21 bp, Homo sapiens
acatggcgggcggagaagctg

SEQ ID NO: 6743 - DNA, 21 bp, Homo sapiens
tccaggggtccagcaggatct

SEQ ID NO: 6744 - DNA, 21 bp, Homo sapiens
ctctggctcctcccgcctgcc

SEQ ID NO: 6745 - DNA, 21 bp, Homo sapiens
ccgccattgccgaggctgagg

SEQ ID NO: 6746 - DNA, 21 bp, Homo sapiens
gcagtggcggcgaggccacgt

SEQ ID NO: 6747 - DNA, 21 bp, Homo sapiens
cgactggcggagcaccgcctt

SEQ ID NO: 6748 - DNA, 21 bp, Homo sapiens
ccaggaggacggggagcgagt

SEQ ID NO: 6749 - DNA, 21 bp, Homo sapiens
tgtcttagtggccaaaattgt

SEQ ID NO: 6750 - DNA, 22 bp, Homo sapiens
ataatcaaacagcagccatacc

SEQ ID NO: 6751 - DNA, 23 bp, Homo sapiens
gtattggctggatggtggtcatt

SEQ ID NO: 6752 - DNA, 21 bp, Homo sapiens
ggaatgaagtccagaggtgag

SEQ ID NO: 6753 - DNA, 22 bp, Homo sapiens
tgcctcccccagcagccgctcc

SEQ ID NO: 6754 - DNA, 23 bp, Homo sapiens
cccgcggaggagcgagcctgtag

SEQ ID NO: 6755 - DNA, 23 bp, Homo sapiens
actccggctcctgcagccacttc

SEQ ID NO: 6756 - DNA, 21 bp, Homo sapiens
gctttgttcacggtgacctgc

SEQ ID NO: 6757 - DNA, 21 bp, Homo sapiens
cggccgagtccgcagacctcg

SEQ ID NO: 6758 - DNA, 21 bp, Homo sapiens
gatcggctggagcggggccgc

SEQ ID NO: 6759 - DNA, 22 bp, Homo sapiens
gacatggctgctggagctgctc

SEQ ID NO: 6760 - DNA, 22 bp, Homo sapiens
tctgtggcagctgcttccggga

SEQ ID NO: 6761 - DNA, 21 bp, Homo sapiens
ggagcttccggcctgcgcgca

SEQ ID NO: 6762 - DNA, 21 bp, Homo sapiens
ggcttttacccgacaaggtaa

SEQ ID NO: 6763 - DNA, 23 bp, Homo sapiens
ggacttggccaggaggagcttgc

SEQ ID NO: 6764 - DNA, 21 bp, Homo sapiens
tgaccccagcgacccatttga

SEQ ID NO: 6765 - DNA, 21 bp, Homo sapiens
cctgaacctgcggtgtcgggg

SEQ ID NO: 6766 - DNA, 22 bp, Homo sapiens
gtccaggcccatcccgcctgcc

SEQ ID NO: 6767 - DNA, 22 bp, Homo sapiens
atactggctgatgtgacagtcc

SEQ ID NO: 6768 - DNA, 21 bp, Homo sapiens
ctcgaagttctcatgtccgat

SEQ ID NO: 6769 - DNA, 22 bp, Homo sapiens
ccatcggcggctgcctcggtgg

SEQ ID NO: 6770 - DNA, 21 bp, Homo sapiens
aagtttgggtcagccattcca

SEQ ID NO: 6771 - DNA, 22 bp, Homo sapiens
aagtccccacaactgccaatgg

SEQ ID NO: 6772 - DNA, 23 bp, Homo sapiens
ccgtggcaggtcagcgtgcacta

SEQ ID NO: 6773 - DNA, 21 bp, Homo sapiens
ttcaaccgaaagctcagtgac

SEQ ID NO: 6774 - DNA, 21 bp, Homo sapiens
aaaatcatcacgtatgacata

SEQ ID NO: 6775 - DNA, 21 bp, Homo sapiens
acctcatatacgttgaattgt

SEQ ID NO: 6776 - DNA, 21 bp, Homo sapiens
ggagtggctgcggtggggaac

SEQ ID NO: 6777 - DNA, 20 bp, Homo sapiens
atcgagtggcttgaacaatg

SEQ ID NO: 6778 - DNA, 22 bp, Homo sapiens
gcactggcagctgagaggaagt

SEQ ID NO: 6779 - DNA, 22 bp, Homo sapiens
agtggctgggctgcgaggcgat

SEQ ID NO: 6780 - DNA, 22 bp, Homo sapiens
tgtggcagggcagcgcgcagtt

SEQ ID NO: 6781 - DNA, 21 bp, Homo sapiens
ggggctttggggctgggcagc

SEQ ID NO: 6782 - DNA, 21 bp, Homo sapiens
agaagggatcgcctggtgccc

SEQ ID NO: 6783 - DNA, 21 bp, Homo sapiens
tggaggataacggggtctggt

SEQ ID NO: 6784 - DNA, 22 bp, Homo sapiens
aaggatttctttactagcctat

SEQ ID NO: 6785 - DNA, 21 bp, Homo sapiens
ataattatccaacagccactg

SEQ ID NO: 6786 - DNA, 20 bp, Homo sapiens
tgtctgtggcttgggcctcc

SEQ ID NO: 6787 - DNA, 21 bp, Homo sapiens
ctgccctctcgctggacaaag

SEQ ID NO: 6788 - DNA, 21 bp, Homo sapiens
tatttcaccgcgacctcacat

SEQ ID NO: 6789 - DNA, 21 bp, Homo sapiens
taagcagcgaggaccagaagc

SEQ ID NO: 6790 - DNA, 21 bp, Homo sapiens
cacgtagggtcgtctcttttt

SEQ ID NO: 6791 - DNA, 22 bp, Homo sapiens
ggcagaaggcagcccccagcca

SEQ ID NO: 6792 - DNA, 21 bp, Homo sapiens
tggcgagccgcgcctacgcgg

SEQ ID NO: 6793 - DNA, 21 bp, Homo sapiens
ggagtggcggtggccttgggg

SEQ ID NO: 6794 - DNA, 20 bp, Homo sapiens
tggatctaaacctgccactg

SEQ ID NO: 6795 - DNA, 21 bp, Homo sapiens
gactctgagggtagccataat

SEQ ID NO: 6796 - DNA, 21 bp, Homo sapiens
aagtacacgacggtgaccaag

SEQ ID NO: 6797 - DNA, 21 bp, Homo sapiens
tcacaaaataaatcagctttt

SEQ ID NO: 6798 - DNA, 20 bp, Homo sapiens
ccctacggctcggacggctg

SEQ ID NO: 6799 - DNA, 21 bp, Homo sapiens
cgtggcacgtgtttattgtcc

SEQ ID NO: 6800 - DNA, 21 bp, Homo sapiens
ggaggatccggcccttgggag

SEQ ID NO: 6801 - DNA, 21 bp, Homo sapiens
agttacgggagaggcttttgg

SEQ ID NO: 6802 - DNA, 21 bp, Homo sapiens
gactacctgcatcacaagtac

SEQ ID NO: 6803 - DNA, 21 bp, Homo sapiens
cttccgtttccgagtgcactt

SEQ ID NO: 6804 - DNA, 21 bp, Homo sapiens
tgatattggccgaagagcaat

SEQ ID NO: 6805 - DNA, 21 bp, Homo sapiens
atacgaagccggtgagtgagc

SEQ ID NO: 6806 - DNA, 21 bp, Homo sapiens
agtggctgctaaatgaagatc

SEQ ID NO: 6807 - DNA, 21 bp, Homo sapiens
gaagtgcgaagggccttgccg

SEQ ID NO: 6808 - DNA, 21 bp, Homo sapiens
tacatagagagacacattgaa

SEQ ID NO: 6809 - DNA, 21 bp, Homo sapiens
gagtggctggatgtggagcac

SEQ ID NO: 6810 - DNA, 21 bp, Homo sapiens
gctcctgggctccagccgcag

SEQ ID NO: 6811 - DNA, 21 bp, Homo sapiens
gcccctcttccccgcgccgtt

SEQ ID NO: 6812 - DNA, 21 bp, Homo sapiens
ttgtaaaccacaacctgacgg

SEQ ID NO: 6813 - DNA, 21 bp, Homo sapiens
accttcaagccggtcaaattc

SEQ ID NO: 6814 - DNA, 21 bp, Homo sapiens
ttacaccctggttatccccat

SEQ ID NO: 6815 - DNA, 21 bp, Homo sapiens
ccgagtggatcttgagcagag

SEQ ID NO: 6816 - DNA, 21 bp, Homo sapiens
gcacccggcccgctgctggac

SEQ ID NO: 6817 - DNA, 21 bp, Homo sapiens
ctccctcaatcagctgcagat

SEQ ID NO: 6818 - DNA, 21 bp, Homo sapiens
actgggtactgatgtaagtac

SEQ ID NO: 6819 - DNA, 21 bp, Homo sapiens
tgagcgataacggaagacctt

SEQ ID NO: 6820 - DNA, 20 bp, Homo sapiens
catcagcggcggggcctcta

SEQ ID NO: 6821 - DNA, 21 bp, Homo sapiens
gatgccccacgagacagaaga

SEQ ID NO: 6822 - DNA, 22 bp, Homo sapiens
agtggctgggcagggtgggccg

SEQ ID NO: 6823 - DNA, 20 bp, Homo sapiens
cccagaggctgcccccaccg

SEQ ID NO: 6824 - DNA, 22 bp, Homo sapiens
cgaggcagggctggggggagcc

SEQ ID NO: 6825 - DNA, 21 bp, Homo sapiens
atatggctggagactggcact

SEQ ID NO: 6826 - DNA, 21 bp, Homo sapiens
gacttggcccgctgccgagaa

SEQ ID NO: 6827 - DNA, 21 bp, Homo sapiens
gccagacttcacagacgccat

SEQ ID NO: 6828 - DNA, 21 bp, Homo sapiens
gattattgggccaaagccagt

SEQ ID NO: 6829 - DNA, 21 bp, Homo sapiens
tgacttcctccgacgccagca

SEQ ID NO: 6830 - DNA, 21 bp, Homo sapiens
ccatggccagggtgcccccac

SEQ ID NO: 6831 - DNA, 20 bp, Homo sapiens
ctaatggcttccccacatag

SEQ ID NO: 6832 - DNA, 21 bp, Homo sapiens
aagcgctcccgcgacgcccgg

SEQ ID NO: 6833 - DNA, 21 bp, Homo sapiens
gaactattacgttgatattgc

SEQ ID NO: 6834 - DNA, 21 bp, Homo sapiens
ggtgagattccgcctgggggg

SEQ ID NO: 6835 - DNA, 23 bp, Homo sapiens
aactggcgggcgcggagctgtag

SEQ ID NO: 6836 - DNA, 21 bp, Homo sapiens
cgcgtggctgggccgccccct

SEQ ID NO: 6837 - DNA, 23 bp, Homo sapiens
ggcaatggcttggttggtcacgg

SEQ ID NO: 6838 - DNA, 22 bp, Homo sapiens
cgctaacctgaagaggcattcc

SEQ ID NO: 6839 - DNA, 21 bp, Homo sapiens
caccgcgtgacctgggatggg

SEQ ID NO: 6840 - DNA, 21 bp, Homo sapiens
tgagtggcggtgtggcagtcc

SEQ ID NO: 6841 - DNA, 23 bp, Homo sapiens
ggatcggcttgaatgacttggac

SEQ ID NO: 6842 - DNA, 21 bp, Homo sapiens
agaaaaatgaaattatggttg

SEQ ID NO: 6843 - DNA, 21 bp, Homo sapiens
catgtccaagcgctgcatgat

SEQ ID NO: 6844 - DNA, 21 bp, Homo sapiens
gctggcggggaggcccggaac

SEQ ID NO: 6845 - DNA, 21 bp, Homo sapiens
gccttgccaatgtcgtcagcc

SEQ ID NO: 6846 - DNA, 23 bp, Homo sapiens
cggctggtggtctgtggtggttg

SEQ ID NO: 6847 - DNA, 21 bp, Homo sapiens
tctgacctggcgggacatgca

SEQ ID NO: 6848 - DNA, 21 bp, Homo sapiens
acagttctgctccagccactc

SEQ ID NO: 6849 - DNA, 21 bp, Homo sapiens
aagtcagagcgtctgcggggg

SEQ ID NO: 6850 - DNA, 22 bp, Homo sapiens
agagtggcagctgcagcaagag

SEQ ID NO: 6851 - DNA, 21 bp, Homo sapiens
ggggatctcccgacgcctggc

SEQ ID NO: 6852 - DNA, 21 bp, Homo sapiens
agcgacagggagtctagagcc

SEQ ID NO: 6853 - DNA, 23 bp, Homo sapiens
tgaaagacaaagtagcacattct

SEQ ID NO: 6854 - DNA, 21 bp, Homo sapiens
aaggtctaccgtcaatcttgc

SEQ ID NO: 6855 - DNA, 23 bp, Homo sapiens
tcttggtttcagacccgccactg

SEQ ID NO: 6856 - DNA, 21 bp, Homo sapiens
tacctttgggctcgactagat

SEQ ID NO: 6857 - DNA, 21 bp, Homo sapiens
ccaggccagcacctgcctctc

SEQ ID NO: 6858 - DNA, 22 bp, Homo sapiens
atactggctgatgtgacagtcc

SEQ ID NO: 6859 - DNA, 23 bp, Homo sapiens
aacggccagcaggcccagcccct

SEQ ID NO: 6860 - DNA, 21 bp, Homo sapiens
gctgtcccatttcttgcggta

SEQ ID NO: 6861 - DNA, 21 bp, Homo sapiens
tcttccaatatgatctccagg

SEQ ID NO: 6862 - DNA, 21 bp, Homo sapiens
aaggacccatactgccaccca

SEQ ID NO: 6863 - DNA, 21 bp, Homo sapiens
catcttctcatacactgcctt

SEQ ID NO: 6864 - DNA, 21 bp, Homo sapiens
aaaatctggcccacaagtcat

SEQ ID NO: 6865 - DNA, 21 bp, Homo sapiens
atgacggcaacgccaggtggg

SEQ ID NO: 6866 - DNA, 21 bp, Homo sapiens
ctatgacggcaacgccaggtg

SEQ ID NO: 6867 - DNA, 21 bp, Homo sapiens
tgacggcaacgccaggtgggt

SEQ ID NO: 6868 - DNA, 21 bp, Homo sapiens
gcagagttccgtgacggtgca

SEQ ID NO: 6869 - DNA, 21 bp, Homo sapiens
ccacggctttctggctgccga

SEQ ID NO: 6870 - DNA, 21 bp, Homo sapiens
tagccaatacttttgaagatt

SEQ ID NO: 6871 - DNA, 21 bp, Homo sapiens
ctagccaatacttttgaagat

SEQ ID NO: 6872 - DNA, 21 bp, Homo sapiens
tgcaggcagcgttccagggca

SEQ ID NO: 6873 - DNA, 21 bp, Homo sapiens
gagtataaaggtttaaaattt

SEQ ID NO: 6874 - DNA, 21 bp, Homo sapiens
ccaaaggctctgcaaatgacc

SEQ ID NO: 6875 - DNA, 21 bp, Homo sapiens
acttcttaagcacattcttgg

SEQ ID NO: 6876 - DNA, 21 bp, Homo sapiens
gcctctcccccggtggggtgg

SEQ ID NO: 6877 - DNA, 21 bp, Homo sapiens
cgcatctctgtttctgagtga

SEQ ID NO: 6878 - DNA, 21 bp, Homo sapiens
ggcgacggctgccacagtgat

SEQ ID NO: 6879 - DNA, 21 bp, Homo sapiens
agggcgacggctgccacagtg

SEQ ID NO: 6880 - DNA, 21 bp, Homo sapiens
gagcggcaaggtgtacgcgct

SEQ ID NO: 6881 - DNA, 21 bp, Homo sapiens
tgtccgcctcgttttgcagag

SEQ ID NO: 6882 - DNA, 23 bp, Homo sapiens
gatcgagtccgctcccgccgctc

SEQ ID NO: 6883 - DNA, 21 bp, Homo sapiens
ggcctgcgcccgcaccctggc

SEQ ID NO: 6884 - DNA, 21 bp, Homo sapiens
gggcctgcgcccgcaccctgg

SEQ ID NO: 6885 - DNA, 21 bp, Homo sapiens
cccgaacaagaaagggtagtt

SEQ ID NO: 6886 - DNA, 21 bp, Homo sapiens
tctcctgctccccttcactga

SEQ ID NO: 6887 - DNA, 21 bp, Homo sapiens
tcgtggtgtgctggttcccct

SEQ ID NO: 6888 - DNA, 21 bp, Homo sapiens
gttcgtggtgtgctggttccc

SEQ ID NO: 6889 - DNA, 21 bp, Homo sapiens
catggtgtcaggggctcggag

SEQ ID NO: 6890 - DNA, 21 bp, Homo sapiens
ttaactcattgtagccactat

SEQ ID NO: 6891 - DNA, 22 bp, Homo sapiens
gcctaaccacatccgccacaag

SEQ ID NO: 6892 - DNA, 21 bp, Homo sapiens
gtagaagtccgcaaagtagag

SEQ ID NO: 6893 - DNA, 21 bp, Homo sapiens
agtgtttcatcctcaggtgag

SEQ ID NO: 6894 - DNA, 21 bp, Homo sapiens
gactgggagccatccatcttg

SEQ ID NO: 6895 - DNA, 21 bp, Homo sapiens
attggcggctagttccactgc

SEQ ID NO: 6896 - DNA, 21 bp, Homo sapiens
tccgctgtggggactgtggcc

SEQ ID NO: 6897 - DNA, 21 bp, Homo sapiens
tgcgagactcaaacgcaatca

SEQ ID NO: 6898 - DNA, 21 bp, Homo sapiens
ttcctggcactgctcttcgtc

SEQ ID NO: 6899 - DNA, 21 bp, Homo sapiens
agaggaggcacctgtgtgggt

SEQ ID NO: 6900 - DNA, 21 bp, Homo sapiens
tctcgcccactttgccgcccc

SEQ ID NO: 6901 - DNA, 21 bp, Homo sapiens
ctcgcccactttgccgccccc

SEQ ID NO: 6902 - DNA, 21 bp, Homo sapiens
gtccagccccaacctgcaggt

SEQ ID NO: 6903 - DNA, 21 bp, Homo sapiens
agtccagccccaacctgcagg

SEQ ID NO: 6904 - DNA, 21 bp, Homo sapiens
cggatgctgagtaccctgaat

SEQ ID NO: 6905 - DNA, 20 bp, Homo sapiens
tgactcggctgggaaccacc

SEQ ID NO: 6906 - DNA, 21 bp, Homo sapiens
tgtctcttctcgccctggcgg

SEQ ID NO: 6907 - DNA, 21 bp, Homo sapiens
tagcatggaccggtacatcgc

SEQ ID NO: 6908 - DNA, 21 bp, Homo sapiens
attccagtgccctataatgag

SEQ ID NO: 6909 - DNA, 21 bp, Homo sapiens
acataacggcggtagagagga

SEQ ID NO: 6910 - DNA, 21 bp, Homo sapiens
acacaggttggtgtcctcaaa

SEQ ID NO: 6911 - DNA, 22 bp, Homo sapiens
caagggcaggtatatatatatg

SEQ ID NO: 6912 - DNA, 21 bp, Homo sapiens
aagtttgccaacaaccccagc

SEQ ID NO: 6913 - DNA, 21 bp, Homo sapiens
gcagacactgctggctgagaa

SEQ ID NO: 6914 - DNA, 21 bp, Homo sapiens
ctattttccagaaatggaaag

SEQ ID NO: 6915 - DNA, 21 bp, Homo sapiens
ctggaacttgaactggaactg

SEQ ID NO: 6916 - DNA, 21 bp, Homo sapiens
aactggaactcgaactggaac

SEQ ID NO: 6917 - DNA, 21 bp, Homo sapiens
aactcgaactggaactggaac

SEQ ID NO: 6918 - DNA, 21 bp, Homo sapiens
aactggaacttgaactggaac

SEQ ID NO: 6919 - DNA, 21 bp, Homo sapiens
actcacagctcgcggagccgc

SEQ ID NO: 6920 - DNA, 21 bp, Homo sapiens
cagagcgtgctctctattact

SEQ ID NO: 6921 - DNA, 21 bp, Homo sapiens
gctccctgaatcctctgcatg

SEQ ID NO: 6922 - DNA, 21 bp, Homo sapiens
gccaccagtgccgcctctgcc

SEQ ID NO: 6923 - DNA, 21 bp, Homo sapiens
tgtttttaagatcttccacct

SEQ ID NO: 6924 - DNA, 21 bp, Homo sapiens
gaattatgaaaaccacgtgtt

SEQ ID NO: 6925 - DNA, 21 bp, Homo sapiens
gaaacagaacaaattaatcag

SEQ ID NO: 6926 - DNA, 21 bp, Homo sapiens
caggcatggcttgggtgtcaa

SEQ ID NO: 6927 - DNA, 21 bp, Homo sapiens
tcatggtcaacgtcctcgggg

SEQ ID NO: 6928 - DNA, 21 bp, Homo sapiens
ccccagtgcactgagatgccc

SEQ ID NO: 6929 - DNA, 21 bp, Homo sapiens
cccagtgcactgagatgcccc

SEQ ID NO: 6930 - DNA, 21 bp, Homo sapiens
gctgatccagctggtgtggga

SEQ ID NO: 6931 - DNA, 21 bp, Homo sapiens
ggggcacccacctgctggcct

SEQ ID NO: 6932 - DNA, 21 bp, Homo sapiens
caggtggcccggggcatggag

SEQ ID NO: 6933 - DNA, 21 bp, Homo sapiens
agaaaaagccttgtttcttcc

SEQ ID NO: 6934 - DNA, 21 bp, Homo sapiens
gtgctgccggccctgggctag

SEQ ID NO: 6935 - DNA, 21 bp, Homo sapiens
ggccaccccctttcgtgttct

SEQ ID NO: 6936 - DNA, 21 bp, Homo sapiens
cccaaggcccgcagggaggtg

SEQ ID NO: 6937 - DNA, 21 bp, Homo sapiens
gacaacaaggccttcaatgag

SEQ ID NO: 6938 - DNA, 21 bp, Homo sapiens
aaaattggatttcgaaaaaat

SEQ ID NO: 6939 - DNA, 21 bp, Homo sapiens
ccactgctttggtgttagatt

SEQ ID NO: 6940 - DNA, 21 bp, Homo sapiens
actgcttatagccctttgggc

SEQ ID NO: 6941 - DNA, 21 bp, Homo sapiens
aggaggtcatgtttgtgctgt

SEQ ID NO: 6942 - DNA, 23 bp, Homo sapiens
gtccagagagagaaggtgaggtg

SEQ ID NO: 6943 - DNA, 21 bp, Homo sapiens
gtgtcactgaacccaaagaac

SEQ ID NO: 6944 - DNA, 21 bp, Homo sapiens
gaccgcttgtatgtctacagt

SEQ ID NO: 6945 - DNA, 21 bp, Homo sapiens
aggggctggacacacagctca

SEQ ID NO: 6946 - DNA, 21 bp, Homo sapiens
gatttcgtcacaggtactttg

SEQ ID NO: 6947 - DNA, 21 bp, Homo sapiens
actgacgatggctcctaccaa

SEQ ID NO: 6948 - DNA, 20 bp, Homo sapiens
ggactacggcggctcctcca

SEQ ID NO: 6949 - DNA, 21 bp, Homo sapiens
tccacattagcctgtgctgtc

SEQ ID NO: 6950 - DNA, 21 bp, Homo sapiens
ggtcaggtaacactaattggc

SEQ ID NO: 6951 - DNA, 21 bp, Homo sapiens
gtgataaagtattgattttgc

SEQ ID NO: 6952 - DNA, 21 bp, Homo sapiens
gtcctcatccgagttctgcag

SEQ ID NO: 6953 - DNA, 21 bp, Homo sapiens
caggaggctccctctggatct

SEQ ID NO: 6954 - DNA, 21 bp, Homo sapiens
caggggttccgcccaccaggg

SEQ ID NO: 6955 - DNA, 21 bp, Homo sapiens
agcacggcctcgctgacctcc

SEQ ID NO: 6956 - DNA, 21 bp, Homo sapiens
tttctcttgcggaaggacttc

SEQ ID NO: 6957 - DNA, 21 bp, Homo sapiens
taggcttccaacggaggtgcg

SEQ ID NO: 6958 - DNA, 23 bp, Homo sapiens
ggttgtggcggatggagttctgg

SEQ ID NO: 6959 - DNA, 22 bp, Homo sapiens
ccctgcagccagcccagccaat

SEQ ID NO: 6960 - DNA, 20 bp, Homo sapiens
cggagcggcagggttccaca

SEQ ID NO: 6961 - DNA, 21 bp, Homo sapiens
gtgcagctcacgcttctcttc

SEQ ID NO: 6962 - DNA, 23 bp, Homo sapiens
aagtggcaggtgagcccgaggtg

SEQ ID NO: 6963 - DNA, 21 bp, Homo sapiens
cgtcttggcctcctccagccg

SEQ ID NO: 6964 - DNA, 21 bp, Homo sapiens
cacccccaccgcgtaaatttc

SEQ ID NO: 6965 - DNA, 21 bp, Homo sapiens
gggcactcaccgaagcctgcc

SEQ ID NO: 6966 - DNA, 21 bp, Homo sapiens
tgcatccgtgtcagtaagtac

SEQ ID NO: 6967 - DNA, 21 bp, Homo sapiens
agtgtggcggtggcagtgtgg

SEQ ID NO: 6968 - DNA, 21 bp, Homo sapiens
caggtctggacgccagcccac

SEQ ID NO: 6969 - DNA, 21 bp, Homo sapiens
cctccgcacgcgctcgatccg

SEQ ID NO: 6970 - DNA, 21 bp, Homo sapiens
gtcgcactgcgcggagaaggg

SEQ ID NO: 6971 - DNA, 21 bp, Homo sapiens
gctggcaatctagaagaaaga

SEQ ID NO: 6972 - DNA, 21 bp, Homo sapiens
atagtggcttgcagaggtact

SEQ ID NO: 6973 - DNA, 23 bp, Homo sapiens
aagaatgacctggccagccgcaa

SEQ ID NO: 6974 - DNA, 21 bp, Homo sapiens
tcggccgccgacaatctgaaa

SEQ ID NO: 6975 - DNA, 21 bp, Homo sapiens
gcatttggaccaagtaagaaa

SEQ ID NO: 6976 - DNA, 22 bp, Homo sapiens
tgcggcggggatggccatgctc

SEQ ID NO: 6977 - DNA, 21 bp, Homo sapiens
gcccctccttctcctccactt

SEQ ID NO: 6978 - DNA, 21 bp, Homo sapiens
tccccgctcctcccccagcca

SEQ ID NO: 6979 - DNA, 20 bp, Homo sapiens
gccattggctggaacggcat

SEQ ID NO: 6980 - DNA, 23 bp, Homo sapiens
tgcaagctggccaggtacctgga

SEQ ID NO: 6981 - DNA, 22 bp, Homo sapiens
gagccacagctgcagccaatgc

SEQ ID NO: 6982 - DNA, 21 bp, Homo sapiens
acagcctaaggacgctgccgg

SEQ ID NO: 6983 - DNA, 21 bp, Homo sapiens
cctgccaggagggcatcgtgc

SEQ ID NO: 6984 - DNA, 22 bp, Homo sapiens
gcagtggcagctgtggttgtat

SEQ ID NO: 6985 - DNA, 23 bp, Homo sapiens
gaatcggctagccacctcctgca

SEQ ID NO: 6986 - DNA, 21 bp, Homo sapiens
cctcgatttgcggggccagtc

SEQ ID NO: 6987 - DNA, 22 bp, Homo sapiens
tgagtggcagctgccgctcgaa

SEQ ID NO: 6988 - DNA, 21 bp, Homo sapiens
acgtatgccaacggtgagaac

SEQ ID NO: 6989 - DNA, 22 bp, Homo sapiens
aggctggcggacgtggtcgcca

SEQ ID NO: 6990 - DNA, 22 bp, Homo sapiens
agacagaccaccaaaaaaaaca

SEQ ID NO: 6991 - DNA, 23 bp, Homo sapiens
gagtggctggacagaggaagatg

SEQ ID NO: 6992 - DNA, 21 bp, Homo sapiens
tggtactgcacggtgaggttg

SEQ ID NO: 6993 - DNA, 22 bp, Homo sapiens
gttgtggctgccgctcccaact

SEQ ID NO: 6994 - DNA, 21 bp, Homo sapiens
agttgaagacgtttaacaatt

SEQ ID NO: 6995 - DNA, 21 bp, Homo sapiens
ccgtggctccgtgccaagatg

SEQ ID NO: 6996 - DNA, 21 bp, Homo sapiens
gcctatggccaccgccacgac

SEQ ID NO: 6997 - DNA, 21 bp, Homo sapiens
gccaagtggcggaagcaggag

SEQ ID NO: 6998 - DNA, 22 bp, Homo sapiens
tgcaccacctagaaaagaaaag

SEQ ID NO: 6999 - DNA, 20 bp, Homo sapiens
cgaatcctttccagccaata

SEQ ID NO: 7000 - DNA, 21 bp, Homo sapiens
gttcgtgagcaactacgccaa

SEQ ID NO: 7001 - DNA, 20 bp, Homo sapiens
ggagaccggcttgccgtcat

SEQ ID NO: 7002 - DNA, 22 bp, Homo sapiens
attgtggctgctgccgccctct

SEQ ID NO: 7003 - DNA, 23 bp, Homo sapiens
gcagcagcacggaccagccactc

SEQ ID NO: 7004 - DNA, 21 bp, Homo sapiens
aagccagtgcgcctgcctctg

SEQ ID NO: 7005 - DNA, 20 bp, Homo sapiens
ttcactggctcggtcagcag

SEQ ID NO: 7006 - DNA, 21 bp, Homo sapiens
atcactgataccagccagtca

SEQ ID NO: 7007 - DNA, 20 bp, Homo sapiens
tgtctgtggcttgggcctcc

SEQ ID NO: 7008 - DNA, 21 bp, Homo sapiens
cacattttccagctgaattcg

SEQ ID NO: 7009 - DNA, 21 bp, Homo sapiens
gcgctgcaccctctgcctcgg

SEQ ID NO: 7010 - DNA, 23 bp, Homo sapiens
cgactgtctctatcctgccactc

SEQ ID NO: 7011 - DNA, 23 bp, Homo sapiens
cagcggcagggaaggaggctttg

SEQ ID NO: 7012 - DNA, 21 bp, Homo sapiens
acttgcagaaacctgccgata

SEQ ID NO: 7013 - DNA, 21 bp, Homo sapiens
ggccaaagatgggtgtaagaa

SEQ ID NO: 7014 - DNA, 21 bp, Homo sapiens
caggcaaaagtagatgcatta

SEQ ID NO: 7015 - DNA, 21 bp, Homo sapiens
tatcctaaaaggcctgattgg

SEQ ID NO: 7016 - DNA, 21 bp, Homo sapiens
tgagatgctgcaggttggcag

SEQ ID NO: 7017 - DNA, 21 bp, Homo sapiens
ggtgagctggtgcaccacttc

SEQ ID NO: 7018 - DNA, 21 bp, Homo sapiens
ggacatccacgtcattaacaa

SEQ ID NO: 7019 - DNA, 21 bp, Homo sapiens
cagtacaatcgactgcagctc

SEQ ID NO: 7020 - DNA, 21 bp, Homo sapiens
acagaaacagctacagaaaca

SEQ ID NO: 7021 - DNA, 21 bp, Homo sapiens
tgcgtgagccggacaccggag

SEQ ID NO: 7022 - DNA, 21 bp, Homo sapiens
tccaagttcctacagaagaga

SEQ ID NO: 7023 - DNA, 23 bp, Homo sapiens
cagtggcgggtatgtccctgtcc

SEQ ID NO: 7024 - DNA, 21 bp, Homo sapiens
ctttaaagtagcagccactat

SEQ ID NO: 7025 - DNA, 21 bp, Homo sapiens
tgtttggtcggcctgcttgtc

SEQ ID NO: 7026 - DNA, 23 bp, Homo sapiens
ccagcggctggcaggcgtagcca

SEQ ID NO: 7027 - DNA, 21 bp, Homo sapiens
atgcaggctggccaggcaggg

SEQ ID NO: 7028 - DNA, 21 bp, Homo sapiens
cccccctcccacagcctctca

SEQ ID NO: 7029 - DNA, 20 bp, Homo sapiens
tcttgcggctggtgccaaaa

SEQ ID NO: 7030 - DNA, 21 bp, Homo sapiens
ttcaaacttgggcagttcttg

SEQ ID NO: 7031 - DNA, 21 bp, Homo sapiens
ctccaagacaggacatcccct

SEQ ID NO: 7032 - DNA, 21 bp, Homo sapiens
ccagtggcagcaccgccaccg

SEQ ID NO: 7033 - DNA, 21 bp, Homo sapiens
ccttctcaggcggatcctggt

SEQ ID NO: 7034 - DNA, 21 bp, Homo sapiens
tgttaaatggcgaaacccgtg

SEQ ID NO: 7035 - DNA, 21 bp, Homo sapiens
caactgcggcgacgcacacac

SEQ ID NO: 7036 - DNA, 21 bp, Homo sapiens
ccttcatctcggtgcatccgg

SEQ ID NO: 7037 - DNA, 23 bp, Homo sapiens
gatcgagtccgctcccgccgctc

SEQ ID NO: 7038 - DNA, 21 bp, Homo sapiens
tacatacgagcagctaaagag

SEQ ID NO: 7039 - DNA, 21 bp, Homo sapiens
acctggagtcgatctgtgagg

SEQ ID NO: 7040 - DNA, 21 bp, Homo sapiens
ctcacaccccgatgaaccttg

SEQ ID NO: 7041 - DNA, 22 bp, Homo sapiens
aagcactcgctgcccagccatg

SEQ ID NO: 7042 - DNA, 21 bp, Homo sapiens
agttctgcaggaaatgcagct

SEQ ID NO: 7043 - DNA, 21 bp, Homo sapiens
ggacttcacgttgaccaggcg

SEQ ID NO: 7044 - DNA, 21 bp, Homo sapiens
tcacaggaacgggcaggtggg

SEQ ID NO: 7045 - DNA, 22 bp, Homo sapiens
agaccgccgcagcagccgagac

SEQ ID NO: 7046 - DNA, 21 bp, Homo sapiens
gaggaacttgcggacgtgctc

SEQ ID NO: 7047 - DNA, 20 bp, Homo sapiens
ggctgcggctgccgcagaag

SEQ ID NO: 7048 - DNA, 21 bp, Homo sapiens
cgctgagtactcacctgatcc

SEQ ID NO: 7049 - DNA, 21 bp, Homo sapiens
cctggcatgacgcctggcaca

SEQ ID NO: 7050 - DNA, 21 bp, Homo sapiens
tgttaaaggctttgccgcatt

SEQ ID NO: 7051 - DNA, 20 bp, Homo sapiens
ctggatccccaagccacaaa

SEQ ID NO: 7052 - DNA, 22 bp, Homo sapiens
aagcaacaacagcagccgttcc

SEQ ID NO: 7053 - DNA, 21 bp, Homo sapiens
tcaccgactccagcgcgatct

SEQ ID NO: 7054 - DNA, 23 bp, Homo sapiens
actggctgggtgaggctggccct

SEQ ID NO: 7055 - DNA, 21 bp, Homo sapiens
attccatgttgatggcacaga

SEQ ID NO: 7056 - DNA, 23 bp, Homo sapiens
gtctgggttcaagctgccatacc

SEQ ID NO: 7057 - DNA, 20 bp, Homo sapiens
tctactggctgggcccactc

SEQ ID NO: 7058 - DNA, 21 bp, Homo sapiens
gaaaggaaatcggctttagaa

SEQ ID NO: 7059 - DNA, 22 bp, Homo sapiens
aggcctggcaccaagccactgg

SEQ ID NO: 7060 - DNA, 23 bp, Homo sapiens
tgccgtggcctgtcccgcctctc

SEQ ID NO: 7061 - DNA, 21 bp, Homo sapiens
cttctatgtagttgatgaaga

SEQ ID NO: 7062 - DNA, 21 bp, Homo sapiens
ttgtttgtagcgatacaaact

SEQ ID NO: 7063 - DNA, 21 bp, Homo sapiens
ctagacgaaaacgttctaaat

SEQ ID NO: 7064 - DNA, 21 bp, Homo sapiens
tacatgggctccatatcaaat

SEQ ID NO: 7065 - DNA, 21 bp, Homo sapiens
gagcggctggtcttgctggag

SEQ ID NO: 7066 - DNA, 23 bp, Homo sapiens
atatggctggtaaggatacgatt

SEQ ID NO: 7067 - DNA, 20 bp, Homo sapiens
tgaggtgggaccagccgtaa

SEQ ID NO: 7068 - DNA, 21 bp, Homo sapiens
acttcagcgacgtgaggacct

SEQ ID NO: 7069 - DNA, 21 bp, Homo sapiens
ggcctgttccgccggaacgcc

SEQ ID NO: 7070 - DNA, 20 bp, Homo sapiens
cctgagtggcttccctgcac

SEQ ID NO: 7071 - DNA, 21 bp, Homo sapiens
aagctgcagctcccgccacgg

SEQ ID NO: 7072 - DNA, 20 bp, Homo sapiens
gctctacggcggctggagct

SEQ ID NO: 7073 - DNA, 21 bp, Homo sapiens
cagctcacggcgctgattggc

SEQ ID NO: 7074 - DNA, 23 bp, Homo sapiens
tgacatccccaccttacacagcc

SEQ ID NO: 7075 - DNA, 21 bp, Homo sapiens
acttacttggagttcgaggaa

SEQ ID NO: 7076 - DNA, 21 bp, Homo sapiens
gacctcagggggccccccagc

SEQ ID NO: 7077 - DNA, 22 bp, Homo sapiens
ccagtggctgctgaccaaaggc

SEQ ID NO: 7078 - DNA, 21 bp, Homo sapiens
actcagggcccctgggtgagg

SEQ ID NO: 7079 - DNA, 21 bp, Homo sapiens
gtgttgcagtgaaatagggta

SEQ ID NO: 7080 - DNA, 22 bp, Homo sapiens
ggctggggggctggtggcgcca

SEQ ID NO: 7081 - DNA, 21 bp, Homo sapiens
ggggagtcaacgagcccctgg

SEQ ID NO: 7082 - DNA, 22 bp, Homo sapiens
gccatggcggctgcagctgctc

SEQ ID NO: 7083 - DNA, 22 bp, Homo sapiens
cgatgacagcagagtctcttct

SEQ ID NO: 7084 - DNA, 21 bp, Homo sapiens
acacgcacctcaaagctgttc

SEQ ID NO: 7085 - DNA, 21 bp, Homo sapiens
ccatcagcactgactactggc

SEQ ID NO: 7086 - DNA, 21 bp, Homo sapiens
gagtggtgaaataacaaggcc

SEQ ID NO: 7087 - DNA, 21 bp, Homo sapiens
gctgcttcctggtgagattct

SEQ ID NO: 7088 - DNA, 21 bp, Homo sapiens
ggagaaggccacagcagtagg

SEQ ID NO: 7089 - DNA, 22 bp, Homo sapiens
gaagaggctgctgtggcttctg

SEQ ID NO: 7090 - DNA, 21 bp, Homo sapiens
tgcacagatcaaaaagagaga

SEQ ID NO: 7091 - DNA, 21 bp, Homo sapiens
catcggatgtgattgaaacac

SEQ ID NO: 7092 - DNA, 21 bp, Homo sapiens
gtggccggagtggccgctgcc

SEQ ID NO: 7093 - DNA, 22 bp, Homo sapiens
gcagaactccatccgccacaat

SEQ ID NO: 7094 - DNA, 21 bp, Homo sapiens
agaaaaaaaaccaaaaaatgg

SEQ ID NO: 7095 - DNA, 20 bp, Homo sapiens
gcctatcggcggggtccaga

SEQ ID NO: 7096 - DNA, 23 bp, Homo sapiens
ctgtggctggcatggcatggagg

SEQ ID NO: 7097 - DNA, 21 bp, Homo sapiens
ggttcgcggctccacggctgg

SEQ ID NO: 7098 - DNA, 21 bp, Homo sapiens
ttctgtagagcgcatgtgcag

SEQ ID NO: 7099 - DNA, 21 bp, Homo sapiens
atgaaggagacgctggccgcc

SEQ ID NO: 7100 - DNA, 21 bp, Homo sapiens
ggagctctcctggaacagctt

SEQ ID NO: 7101 - DNA, 21 bp, Homo sapiens
gagtgtgacgcgctaccattc

SEQ ID NO: 7102 - DNA, 21 bp, Homo sapiens
tccccgcatccgccgaggcat

SEQ ID NO: 7103 - DNA, 21 bp, Homo sapiens
ttatatttcctcctgtaagaa

SEQ ID NO: 7104 - DNA, 21 bp, Homo sapiens
gggactccccggagatggtaa

SEQ ID NO: 7105 - DNA, 21 bp, Homo sapiens
aggctgccaacaacgtgcgag

SEQ ID NO: 7106 - DNA, 21 bp, Homo sapiens
ggttccaggtgtcagggggcc

SEQ ID NO: 7107 - DNA, 21 bp, Homo sapiens
agaagaaaaagaaaaagaaaa

SEQ ID NO: 7108 - DNA, 21 bp, Homo sapiens
tgcgcccccctgtatgatgca

SEQ ID NO: 7109 - DNA, 21 bp, Homo sapiens
ctctgcacgtgagcgcactga

SEQ ID NO: 7110 - DNA, 21 bp, Homo sapiens
acgatgcccctgttccctcac

SEQ ID NO: 7111 - DNA, 21 bp, Homo sapiens
attacccctactaccggacgg

SEQ ID NO: 7112 - DNA, 21 bp, Homo sapiens
cgggggcttcgtgccgtgccc

SEQ ID NO: 7113 - DNA, 21 bp, Homo sapiens
gcagtccacttccacagtgag

SEQ ID NO: 7114 - DNA, 21 bp, Homo sapiens
taagaccctattaaaaaatca

SEQ ID NO: 7115 - DNA, 21 bp, Homo sapiens
tgacgagtacgatcgaaggcg

SEQ ID NO: 7116 - DNA, 21 bp, Homo sapiens
gcccgaacaagaaagggtagt

SEQ ID NO: 7117 - DNA, 21 bp, Homo sapiens
tggaatggaagtatccttttt

SEQ ID NO: 7118 - DNA, 21 bp, Homo sapiens
ggaatggaagtatcctttttt

SEQ ID NO: 7119 - DNA, 21 bp, Homo sapiens
caagcaggtaggagaggtcca

SEQ ID NO: 7120 - DNA, 21 bp, Homo sapiens
ctcacctttccggatgggtcg

SEQ ID NO: 7121 - DNA, 21 bp, Homo sapiens
agtgttcgtggtgtgctggtt

SEQ ID NO: 7122 - DNA, 21 bp, Homo sapiens
gctatgacaccagtggccagc

SEQ ID NO: 7123 - DNA, 21 bp, Homo sapiens
ttcttcaggtctgagaggcag

SEQ ID NO: 7124 - DNA, 21 bp, Homo sapiens
tggaatgcttccgccgtctcc

SEQ ID NO: 7125 - DNA, 21 bp, Homo sapiens
agataccagacgaagaagtca

SEQ ID NO: 7126 - DNA, 23 bp, Homo sapiens
cgcggcggggcaagggccgctcc

SEQ ID NO: 7127 - DNA, 21 bp, Homo sapiens
tcctctgaagcgccaagagaa

SEQ ID NO: 7128 - DNA, 21 bp, Homo sapiens
tcttcgtttcggacagagcaa

SEQ ID NO: 7129 - DNA, 21 bp, Homo sapiens
cacagacactgtgagaacaag

SEQ ID NO: 7130 - DNA, 21 bp, Homo sapiens
actgggagccatccatcttgg

SEQ ID NO: 7131 - DNA, 21 bp, Homo sapiens
cgacagccacaagcttgtctt

SEQ ID NO: 7132 - DNA, 21 bp, Homo sapiens
gtaggatgaggagaagcccgt

SEQ ID NO: 7133 - DNA, 21 bp, Homo sapiens
cttcctggcactgctcttcgt

SEQ ID NO: 7134 - DNA, 21 bp, Homo sapiens
tgggcaggctgaccacctggg

SEQ ID NO: 7135 - DNA, 21 bp, Homo sapiens
gcgagactcaaacgcaatcat

SEQ ID NO: 7136 - DNA, 21 bp, Homo sapiens
catgggcggcccgggtggcag

SEQ ID NO: 7137 - DNA, 21 bp, Homo sapiens
cctgcaccgggaaccagcaga

SEQ ID NO: 7138 - DNA, 21 bp, Homo sapiens
gattcgatatctatgacccct

SEQ ID NO: 7139 - DNA, 22 bp, Homo sapiens
tccaggctccagccgccacacc

SEQ ID NO: 7140 - DNA, 21 bp, Homo sapiens
cgggtagggcgcgaactcggc

SEQ ID NO: 7141 - DNA, 21 bp, Homo sapiens
ctccaggcccacagctgccac

SEQ ID NO: 7142 - DNA, 21 bp, Homo sapiens
aggttgaggtctcacatgtgg

SEQ ID NO: 7143 - DNA, 21 bp, Homo sapiens
caggttggtgtcctcaaagag

SEQ ID NO: 7144 - DNA, 21 bp, Homo sapiens
tcccccactgtgccgctccct

SEQ ID NO: 7145 - DNA, 21 bp, Homo sapiens
ccggctgcgcgatgagttcca

SEQ ID NO: 7146 - DNA, 21 bp, Homo sapiens
cttctagctcctaagatatga

SEQ ID NO: 7147 - DNA, 21 bp, Homo sapiens
tccggctgcgcgatgagttcc

SEQ ID NO: 7148 - DNA, 21 bp, Homo sapiens
gggaaataacaaattaatcaa

SEQ ID NO: 7149 - DNA, 21 bp, Homo sapiens
cacctctgccgcccgccgtat

SEQ ID NO: 7150 - DNA, 21 bp, Homo sapiens
tgccatcttctgtgtggcagt

SEQ ID NO: 7151 - DNA, 21 bp, Homo sapiens
gacgtgaacgccatcgcaggc

SEQ ID NO: 7152 - DNA, 21 bp, Homo sapiens
tgctgcaggatcttggcgtag

SEQ ID NO: 7153 - DNA, 21 bp, Homo sapiens
ccctccaggaggtgtcttgcg

SEQ ID NO: 7154 - DNA, 21 bp, Homo sapiens
cgcttcccatccttccttaag

SEQ ID NO: 7155 - DNA, 21 bp, Homo sapiens
gcttcccatccttccttaagg

SEQ ID NO: 7156 - DNA, 21 bp, Homo sapiens
catggtcaacgtcctcggggg

SEQ ID NO: 7157 - DNA, 21 bp, Homo sapiens
ttcctggggctctgggcccac

SEQ ID NO: 7158 - DNA, 21 bp, Homo sapiens
tgctgttgtgtcaacagctct

SEQ ID NO: 7159 - DNA, 21 bp, Homo sapiens
taaatctcaccatcacctctc

SEQ ID NO: 7160 - DNA, 21 bp, Homo sapiens
cccagatgacctcctgagact

SEQ ID NO: 7161 - DNA, 23 bp, Homo sapiens
agaaaagtggcttgcaaaatctt

SEQ ID NO: 7162 - DNA, 21 bp, Homo sapiens
ctgaaatgttccagaaggacc

SEQ ID NO: 7163 - DNA, 21 bp, Homo sapiens
ctacaagggatgagccagcca

SEQ ID NO: 7164 - DNA, 21 bp, Homo sapiens
tttttaaccagtcctcaaacc

SEQ ID NO: 7165 - DNA, 21 bp, Homo sapiens
gtaatctgaacggtcatggag

SEQ ID NO: 7166 - DNA, 21 bp, Homo sapiens
ggcgaggagggggccgacgcc

SEQ ID NO: 7167 - DNA, 23 bp, Homo sapiens
aaatggccatgaagaagtatgct

SEQ ID NO: 7168 - DNA, 21 bp, Homo sapiens
gcagctggtgcggtgatagtg

SEQ ID NO: 7169 - DNA, 21 bp, Homo sapiens
agagctgagcagtaccagcct

SEQ ID NO: 7170 - DNA, 21 bp, Homo sapiens
accgcttgtatgtctacagta

SEQ ID NO: 7171 - DNA, 21 bp, Homo sapiens
tttcgtcacaggtactttgag

SEQ ID NO: 7172 - DNA, 21 bp, Homo sapiens
tgacgatggctcctaccaaaa

SEQ ID NO: 7173 - DNA, 21 bp, Homo sapiens
gacgatggctcctaccaaaac

SEQ ID NO: 7174 - DNA, 21 bp, Homo sapiens
ccctcctgagcccccttgctt

SEQ ID NO: 7175 - DNA, 21 bp, Homo sapiens
cccccctcccacagcctctca

SEQ ID NO: 7176 - DNA, 21 bp, Homo sapiens
aaagctcttcgtgggagggct

SEQ ID NO: 7177 - DNA, 21 bp, Homo sapiens
gatcacacacggaacttaacg

SEQ ID NO: 7178 - DNA, 21 bp, Homo sapiens
gccgtgaaacgtatatggaat

SEQ ID NO: 7179 - DNA, 21 bp, Homo sapiens
tcccagcagccggaggcagca

SEQ ID NO: 7180 - DNA, 21 bp, Homo sapiens
ttgaagaaaatctaaagacaa

SEQ ID NO: 7181 - DNA, 21 bp, Homo sapiens
acttgccaaacgtaaaaactc

SEQ ID NO: 7182 - DNA, 21 bp, Homo sapiens
tgagaaggtgtggtccatggc

SEQ ID NO: 7183 - DNA, 22 bp, Homo sapiens
accccgagggacgagccgatgt

SEQ ID NO: 7184 - DNA, 23 bp, Homo sapiens
gctaatgattatacctgccatgc

SEQ ID NO: 7185 - DNA, 21 bp, Homo sapiens
ttcctaagcaatgtagctttg

SEQ ID NO: 7186 - DNA, 23 bp, Homo sapiens
gtcctgcgccgcacccccgcctg

SEQ ID NO: 7187 - DNA, 22 bp, Homo sapiens
agaagttcagacgagccacatt

SEQ ID NO: 7188 - DNA, 23 bp, Homo sapiens
ccgtggcaggtcagcgtgcacta

SEQ ID NO: 7189 - DNA, 21 bp, Homo sapiens
ggcactatgggattaaagcta

SEQ ID NO: 7190 - DNA, 21 bp, Homo sapiens
tgtggctgtcgtggctgctct

SEQ ID NO: 7191 - DNA, 21 bp, Homo sapiens
tgccaccaacgattgtgagat

SEQ ID NO: 7192 - DNA, 22 bp, Homo sapiens
gctgtggcggctgcagaactcc

SEQ ID NO: 7193 - DNA, 21 bp, Homo sapiens
cgcaaaaagcgccccagccgg

SEQ ID NO: 7194 - DNA, 21 bp, Homo sapiens
cccgcagatccgttggaagta

SEQ ID NO: 7195 - DNA, 21 bp, Homo sapiens
tccgtccagtcatttttattg

SEQ ID NO: 7196 - DNA, 22 bp, Homo sapiens
cttgtggcttgattgcaaagtc

SEQ ID NO: 7197 - DNA, 20 bp, Homo sapiens
cctcatggctgccctcccgg

SEQ ID NO: 7198 - DNA, 20 bp, Homo sapiens
agcagtggctgcagctgcag

SEQ ID NO: 7199 - DNA, 21 bp, Homo sapiens
tgaaggatatggagctggatg

SEQ ID NO: 7200 - DNA, 22 bp, Homo sapiens
gcagcggcggctgctgtacaac

SEQ ID NO: 7201 - DNA, 21 bp, Homo sapiens
agccacagatgcctgaggacc

SEQ ID NO: 7202 - DNA, 21 bp, Homo sapiens
cgccgccgccgcccgcgcggc

SEQ ID NO: 7203 - DNA, 21 bp, Homo sapiens
ttcccagtgtcgccaggaggg

SEQ ID NO: 7204 - DNA, 21 bp, Homo sapiens
cagctgcagcgtctggggtgt

SEQ ID NO: 7205 - DNA, 21 bp, Homo sapiens
ccgggccagctccagccgcac

SEQ ID NO: 7206 - DNA, 21 bp, Homo sapiens
catcgccatcgagctctctga

SEQ ID NO: 7207 - DNA, 21 bp, Homo sapiens
accacaaggtaaaatagtttc

SEQ ID NO: 7208 - DNA, 21 bp, Homo sapiens
aaagtggcggtggtggacccg

SEQ ID NO: 7209 - DNA, 21 bp, Homo sapiens
agggagagtggcaagaatggg

SEQ ID NO: 7210 - DNA, 23 bp, Homo sapiens
atctcgagcctctccagccactc

SEQ ID NO: 7211 - DNA, 21 bp, Homo sapiens
cagtggctggtgcagcccgcc

SEQ ID NO: 7212 - DNA, 21 bp, Homo sapiens
agggcagggacgacgtggggc

SEQ ID NO: 7213 - DNA, 21 bp, Homo sapiens
ccgcctgcaacgagtggctca

SEQ ID NO: 7214 - DNA, 21 bp, Homo sapiens
aacctcccccgattggtgaga

SEQ ID NO: 7215 - DNA, 21 bp, Homo sapiens
ataaacgggcctaagaaaata

SEQ ID NO: 7216 - DNA, 22 bp, Homo sapiens
agaatgcagcgacccagccact

SEQ ID NO: 7217 - DNA, 21 bp, Homo sapiens
cgccagcgtggcacgggagac

SEQ ID NO: 7218 - DNA, 22 bp, Homo sapiens
gcagcggcggctgctgagcgcc

SEQ ID NO: 7219 - DNA, 21 bp, Homo sapiens
ctctgggtgcggggtgagtgt

SEQ ID NO: 7220 - DNA, 21 bp, Homo sapiens
tatttacatgaaatctttgcg

SEQ ID NO: 7221 - DNA, 21 bp, Homo sapiens
agtttcgtttctggacgcagg

SEQ ID NO: 7222 - DNA, 22 bp, Homo sapiens
actgtggctgcagccactggcg

SEQ ID NO: 7223 - DNA, 22 bp, Homo sapiens
ctgggctgccagccagccattg

SEQ ID NO: 7224 - DNA, 21 bp, Homo sapiens
gccccccacccggaaatccag

SEQ ID NO: 7225 - DNA, 23 bp, Homo sapiens
gacatggcttgtgttacatccct

SEQ ID NO: 7226 - DNA, 23 bp, Homo sapiens
gtacggcaggaacgactctcgtc

SEQ ID NO: 7227 - DNA, 21 bp, Homo sapiens
gggtgcctctgggaagatgag

SEQ ID NO: 7228 - DNA, 22 bp, Homo sapiens
ccagtggctgccgccttctttc

SEQ ID NO: 7229 - DNA, 22 bp, Homo sapiens
gtggctggggttgtagcagtat

SEQ ID NO: 7230 - DNA, 21 bp, Homo sapiens
tgctttcccccgggcccaggt

SEQ ID NO: 7231 - DNA, 22 bp, Homo sapiens
actgtggctgctggaggaccag

SEQ ID NO: 7232 - DNA, 21 bp, Homo sapiens
ctgctgcagcaccgccgatgg

SEQ ID NO: 7233 - DNA, 21 bp, Homo sapiens
gagcaagccactcagaatttc

SEQ ID NO: 7234 - DNA, 20 bp, Homo sapiens
tggcatggcaggcttggcct

SEQ ID NO: 7235 - DNA, 21 bp, Homo sapiens
tgagggtcaacgtcaagcggg

SEQ ID NO: 7236 - DNA, 21 bp, Homo sapiens
agtctctctcccaaggcaaac

SEQ ID NO: 7237 - DNA, 21 bp, Homo sapiens
ccggccgcgcgccgaggtggc

SEQ ID NO: 7238 - DNA, 22 bp, Homo sapiens
ctatactgtcagccgccgctcc

SEQ ID NO: 7239 - DNA, 23 bp, Homo sapiens
gcaagatccctaacagccacagg

SEQ ID NO: 7240 - DNA, 21 bp, Homo sapiens
tgccaagaaagatgcaaagga

SEQ ID NO: 7241 - DNA, 21 bp, Homo sapiens
cgctcggacctcaccaagcac

SEQ ID NO: 7242 - DNA, 21 bp, Homo sapiens
tgctgttcccctccagcagct

SEQ ID NO: 7243 - DNA, 21 bp, Homo sapiens
caatcatgtcgagaaataacg

SEQ ID NO: 7244 - DNA, 22 bp, Homo sapiens
atacggcgggatgatgagctga

SEQ ID NO: 7245 - DNA, 20 bp, Homo sapiens
agcagcggcaggctccgcac

SEQ ID NO: 7246 - DNA, 21 bp, Homo sapiens
gtggctggggtgggggaagtg

SEQ ID NO: 7247 - DNA, 21 bp, Homo sapiens
gtcttccccagtagccactgc

SEQ ID NO: 7248 - DNA, 21 bp, Homo sapiens
gcgcagatgcgaaaggcctgg

SEQ ID NO: 7249 - DNA, 21 bp, Homo sapiens
gcgatcggcgggtccctggag

SEQ ID NO: 7250 - DNA, 22 bp, Homo sapiens
ggcagaaggcagcccccagcca

SEQ ID NO: 7251 - DNA, 21 bp, Homo sapiens
tggcggacagcgttgacgacg

SEQ ID NO: 7252 - DNA, 21 bp, Homo sapiens
accgagacctacgtggaggca

SEQ ID NO: 7253 - DNA, 21 bp, Homo sapiens
aggatggctctggcgatccat

SEQ ID NO: 7254 - DNA, 23 bp, Homo sapiens
atctcgagcctctccagccactc

SEQ ID NO: 7255 - DNA, 21 bp, Homo sapiens
tctaacaaatcttgatttcct

SEQ ID NO: 7256 - DNA, 23 bp, Homo sapiens
tcccacctcctctcccagccatc

SEQ ID NO: 7257 - DNA, 21 bp, Homo sapiens
cactgagtgccctttacaaat

SEQ ID NO: 7258 - DNA, 21 bp, Homo sapiens
ggtgccccgaggcctgtgcgc

SEQ ID NO: 7259 - DNA, 20 bp, Homo sapiens
gggtgtggctggttcctgag

SEQ ID NO: 7260 - DNA, 21 bp, Homo sapiens
ttggacaggagcaagtctctc

SEQ ID NO: 7261 - DNA, 21 bp, Homo sapiens
ctcctcctgccgcggcgccgc

SEQ ID NO: 7262 - DNA, 21 bp, Homo sapiens
tgtgtggctgcccggcttccg

SEQ ID NO: 7263 - DNA, 22 bp, Homo sapiens
gctgagtggcagctgccgctcg

SEQ ID NO: 7264 - DNA, 23 bp, Homo sapiens
gcaaagccgcaggccctgccggc

SEQ ID NO: 7265 - DNA, 23 bp, Homo sapiens
tagtggcaggacagcgatgtatc

SEQ ID NO: 7266 - DNA, 21 bp, Homo sapiens
ctgcggcagacggccgccaag

SEQ ID NO: 7267 - DNA, 21 bp, Homo sapiens
ggctgtgcccaggggccgcca

SEQ ID NO: 7268 - DNA, 21 bp, Homo sapiens
acaattgaacgcttaaaggag

SEQ ID NO: 7269 - DNA, 22 bp, Homo sapiens
gtggctggggctgtagtgggcg

SEQ ID NO: 7270 - DNA, 22 bp, Homo sapiens
acagcgtcggctggagccgctg

SEQ ID NO: 7271 - DNA, 23 bp, Homo sapiens
acacccctgctgtccctgccatg

SEQ ID NO: 7272 - DNA, 21 bp, Homo sapiens
cggctggtggtgtatagagat

SEQ ID NO: 7273 - DNA, 21 bp, Homo sapiens
gaccacgggggcagccacagc

SEQ ID NO: 7274 - DNA, 22 bp, Homo sapiens
gagcaatggcggctgccagtat

SEQ ID NO: 7275 - DNA, 23 bp, Homo sapiens
cagcggcaggtgagcctagacag

SEQ ID NO: 7276 - DNA, 21 bp, Homo sapiens
gccaagcacaccaaacagagc

SEQ ID NO: 7277 - DNA, 23 bp, Homo sapiens
cttcggctggtcagggacttggt

SEQ ID NO: 7278 - DNA, 21 bp, Homo sapiens
cgtgagtcagacaccagccat

SEQ ID NO: 7279 - DNA, 21 bp, Homo sapiens
ctcaaactcccggatgttgcg

SEQ ID NO: 7280 - DNA, 21 bp, Homo sapiens
ggcgtccaggcggatctccac

SEQ ID NO: 7281 - DNA, 22 bp, Homo sapiens
gaggcagcacagctgccatgat

SEQ ID NO: 7282 - DNA, 23 bp, Homo sapiens
gcagcagcagcccgagccagtgg

SEQ ID NO: 7283 - DNA, 21 bp, Homo sapiens
acctcgggaacttctggaagg

SEQ ID NO: 7284 - DNA, 21 bp, Homo sapiens
ccggatggcaccactctgcag

SEQ ID NO: 7285 - DNA, 21 bp, Homo sapiens
ccaggaaggcgcctctcaata

SEQ ID NO: 7286 - DNA, 21 bp, Homo sapiens
ctggcctcaggcacagcacac

SEQ ID NO: 7287 - DNA, 21 bp, Homo sapiens
ctgggtgtcggggtccccgcg

SEQ ID NO: 7288 - DNA, 21 bp, Homo sapiens
catgcgctgcgtgtcggtgct

SEQ ID NO: 7289 - DNA, 22 bp, Homo sapiens
taccgggcgcggccgccgcgcg

SEQ ID NO: 7290 - DNA, 21 bp, Homo sapiens
gattggctggcgaggctctgt

SEQ ID NO: 7291 - DNA, 21 bp, Homo sapiens
tcgcggctccacggctggggg

SEQ ID NO: 7292 - DNA, 21 bp, Homo sapiens
gttcgcggctccacggctggg

SEQ ID NO: 7293 - DNA, 21 bp, Homo sapiens
acggcaacgccaggtgggtgg

SEQ ID NO: 7294 - DNA, 21 bp, Homo sapiens
gacggcaacgccaggtgggtg

SEQ ID NO: 7295 - DNA, 21 bp, Homo sapiens
tatgacggcaacgccaggtgg

SEQ ID NO: 7296 - DNA, 21 bp, Homo sapiens
tccacggctttctggctgccg

SEQ ID NO: 7297 - DNA, 21 bp, Homo sapiens
ggctgccaacaacgtgcgagt

SEQ ID NO: 7298 - DNA, 21 bp, Homo sapiens
agcctctcccccggtggggtg

SEQ ID NO: 7299 - DNA, 21 bp, Homo sapiens
gctgccaacaacgtgcgagtg

SEQ ID NO: 7300 - DNA, 21 bp, Homo sapiens
cggttccaggtgtcagggggc

SEQ ID NO: 7301 - DNA, 21 bp, Homo sapiens
ttacctattctctgtctgtca

SEQ ID NO: 7302 - DNA, 21 bp, Homo sapiens
tttacctattctctgtctgtc

SEQ ID NO: 7303 - DNA, 21 bp, Homo sapiens
actctgcacgtgagcgcactg

SEQ ID NO: 7304 - DNA, 21 bp, Homo sapiens
gttctggacagggcgccggat

SEQ ID NO: 7305 - DNA, 21 bp, Homo sapiens
gggcgacggctgccacagtga

SEQ ID NO: 7306 - DNA, 21 bp, Homo sapiens
gccattacttacctggggcgg

SEQ ID NO: 7307 - DNA, 21 bp, Homo sapiens
ttacttacctggggcggagag

SEQ ID NO: 7308 - DNA, 22 bp, Homo sapiens
tcagtggcagcagaactggccc

SEQ ID NO: 7309 - DNA, 21 bp, Homo sapiens
cgtgccggcgtttctcacgcc

SEQ ID NO: 7310 - DNA, 21 bp, Homo sapiens
cgtctccaaagtgtctcagga

SEQ ID NO: 7311 - DNA, 21 bp, Homo sapiens
aggagaacgagccaccaccat

SEQ ID NO: 7312 - DNA, 21 bp, Homo sapiens
ccagcactgtggtgacaatga

SEQ ID NO: 7313 - DNA, 21 bp, Homo sapiens
gaatggaagtatccttttttt

SEQ ID NO: 7314 - DNA, 21 bp, Homo sapiens
tctcacctttccggatgggtc

SEQ ID NO: 7315 - DNA, 21 bp, Homo sapiens
catacagctcgtccaaaggct

SEQ ID NO: 7316 - DNA, 21 bp, Homo sapiens
gtaaattatggccgcatctcc

SEQ ID NO: 7317 - DNA, 21 bp, Homo sapiens
ggtggctccatccctgtctcc

SEQ ID NO: 7318 - DNA, 21 bp, Homo sapiens
ccagaacggggggtacccaac

SEQ ID NO: 7319 - DNA, 21 bp, Homo sapiens
tcttcaggtctgagaggcagg

SEQ ID NO: 7320 - DNA, 21 bp, Homo sapiens
ggaatgcttccgccgtctcca

SEQ ID NO: 7321 - DNA, 21 bp, Homo sapiens
ccgagacggcgcccggcgcgt

SEQ ID NO: 7322 - DNA, 21 bp, Homo sapiens
gtactgtgacctgcaaccaag

SEQ ID NO: 7323 - DNA, 21 bp, Homo sapiens
cagtggttagcgtgatggccc

SEQ ID NO: 7324 - DNA, 21 bp, Homo sapiens
agtggattactcaggttagct

SEQ ID NO: 7325 - DNA, 21 bp, Homo sapiens
tgctcaaggacggcgcccggc

SEQ ID NO: 7326 - DNA, 21 bp, Homo sapiens
cgccgccgccgccacgggcgc

SEQ ID NO: 7327 - DNA, 22 bp, Homo sapiens
tcagttgctcagcccgccgttc

SEQ ID NO: 7328 - DNA, 21 bp, Homo sapiens
ctctcgccagccgactgcaag

SEQ ID NO: 7329 - DNA, 21 bp, Homo sapiens
gagactcaaacgcaatcatta

SEQ ID NO: 7330 - DNA, 21 bp, Homo sapiens
agactcaaacgcaatcattaa

SEQ ID NO: 7331 - DNA, 21 bp, Homo sapiens
ttaatcaaattttcaaaagag

SEQ ID NO: 7332 - DNA, 21 bp, Homo sapiens
taggatgaggagaagcccgtg

SEQ ID NO: 7333 - DNA, 21 bp, Homo sapiens
gatgaggacataagagcagaa

SEQ ID NO: 7334 - DNA, 21 bp, Homo sapiens
atgaggacataagagcagaag

SEQ ID NO: 7335 - DNA, 21 bp, Homo sapiens
tgaggacataagagcagaagc

SEQ ID NO: 7336 - DNA, 21 bp, Homo sapiens
acagaaccccctggcagccag

SEQ ID NO: 7337 - DNA, 21 bp, Homo sapiens
cagaaccccctggcagccagt

SEQ ID NO: 7338 - DNA, 21 bp, Homo sapiens
gccctgcgcaaccacgtgcgg

SEQ ID NO: 7339 - DNA, 21 bp, Homo sapiens
cagccccaacctgcaggtgag

SEQ ID NO: 7340 - DNA, 21 bp, Homo sapiens
atgggcggcccgggtggcaga

SEQ ID NO: 7341 - DNA, 20 bp, Homo sapiens
ccctacggctcggacggctg

SEQ ID NO: 7342 - DNA, 21 bp, Homo sapiens
atagcgaccaaccgccacaaa

SEQ ID NO: 7343 - DNA, 21 bp, Homo sapiens
ttattggcttctcgaacttcc

SEQ ID NO: 7344 - DNA, 21 bp, Homo sapiens
ctcacactcttctcctggtga

SEQ ID NO: 7345 - DNA, 21 bp, Homo sapiens
acaggttggtgtcctcaaaga

SEQ ID NO: 7346 - DNA, 21 bp, Homo sapiens
ccagtgctggcagtggccaca

SEQ ID NO: 7347 - DNA, 21 bp, Homo sapiens
ggccgcggtgcgcccatcagg

SEQ ID NO: 7348 - DNA, 21 bp, Homo sapiens
cggctgcgcgatgagttccag

SEQ ID NO: 7349 - DNA, 21 bp, Homo sapiens
tctagctcctaagatatgaag

SEQ ID NO: 7350 - DNA, 21 bp, Homo sapiens
catgcaccgccacatcgagct

SEQ ID NO: 7351 - DNA, 21 bp, Homo sapiens
gaatctggcatgaaggacatc

SEQ ID NO: 7352 - DNA, 21 bp, Homo sapiens
ccatggagcccaacgagatga

SEQ ID NO: 7353 - DNA, 21 bp, Homo sapiens
caccccaggcgcagtatctgc

SEQ ID NO: 7354 - DNA, 21 bp, Homo sapiens
ctgccatcttctgtgtggcag

SEQ ID NO: 7355 - DNA, 21 bp, Homo sapiens
ggcatgaaggtagagaagaag

SEQ ID NO: 7356 - DNA, 21 bp, Homo sapiens
acccagcagagtgtaggtcag

SEQ ID NO: 7357 - DNA, 21 bp, Homo sapiens
cctccaggaggtgtcttgcgg

SEQ ID NO: 7358 - DNA, 21 bp, Homo sapiens
ggctccctgaatcctctgcat

SEQ ID NO: 7359 - DNA, 21 bp, Homo sapiens
aggaccctgccccgctctggg

SEQ ID NO: 7360 - DNA, 21 bp, Homo sapiens
ggaccctgccccgctctgggg

SEQ ID NO: 7361 - DNA, 21 bp, Homo sapiens
gggcaacgacgagaagaagat

SEQ ID NO: 7362 - DNA, 21 bp, Homo sapiens
gaggacaaattcttgtaactt

SEQ ID NO: 7363 - DNA, 21 bp, Homo sapiens
agagtcttgcgcttgcagata

SEQ ID NO: 7364 - DNA, 21 bp, Homo sapiens
tcctggggctctgggcccacc

SEQ ID NO: 7365 - DNA, 21 bp, Homo sapiens
aggactcttgtcaagagagag

SEQ ID NO: 7366 - DNA, 21 bp, Homo sapiens
agctgatccagctggtgtggg

SEQ ID NO: 7367 - DNA, 21 bp, Homo sapiens
actcatcagttccttcgtgcc

SEQ ID NO: 7368 - DNA, 21 bp, Homo sapiens
tggttggtagacccggggcgg

SEQ ID NO: 7369 - DNA, 23 bp, Homo sapiens
ggcagcagtggcagcagcagcag

SEQ ID NO: 7370 - DNA, 21 bp, Homo sapiens
aggacctacaagggatgagcc

SEQ ID NO: 7371 - DNA, 21 bp, Homo sapiens
tcatagctttggcatgattca

SEQ ID NO: 7372 - DNA, 21 bp, Homo sapiens
atggccgtcacgccggccgca

SEQ ID NO: 7373 - DNA, 21 bp, Homo sapiens
tactgccagcgctctgtccac

SEQ ID NO: 7374 - DNA, 21 bp, Homo sapiens
ctggcatccgcggatattgac

SEQ ID NO: 7375 - DNA, 21 bp, Homo sapiens
aaagcactcaacagccaccgt

SEQ ID NO: 7376 - DNA, 21 bp, Homo sapiens
cagcctcaccacctggccaca

SEQ ID NO: 7377 - DNA, 21 bp, Homo sapiens
gccactccccggtggggcagt

SEQ ID NO: 7378 - DNA, 21 bp, Homo sapiens
ccactggggcccagcaccagc

SEQ ID NO: 7379 - DNA, 22 bp, Homo sapiens
ggctgcctgcgacccccgccat

SEQ ID NO: 7380 - DNA, 21 bp, Homo sapiens
cccgtcttcacgtacagaaga

SEQ ID NO: 7381 - DNA, 21 bp, Homo sapiens
cacacgcggcgcaggtgccgc

SEQ ID NO: 7382 - DNA, 21 bp, Homo sapiens
gtgcacacgcggcgcaggtgc

SEQ ID NO: 7383 - DNA, 21 bp, Homo sapiens
ttcccctcatctgtgtaacaa

SEQ ID NO: 7384 - DNA, 21 bp, Homo sapiens
tgtcttagtggccaaaattgt

SEQ ID NO: 7385 - DNA, 21 bp, Homo sapiens
aattactcagcacacttgggt

SEQ ID NO: 7386 - DNA, 21 bp, Homo sapiens
caccaccgtcccaaagaagcc

SEQ ID NO: 7387 - DNA, 21 bp, Homo sapiens
cggcctcagcgtcccccccac

SEQ ID NO: 7388 - DNA, 21 bp, Homo sapiens
ttggctccatcggctgcttga

SEQ ID NO: 7389 - DNA, 22 bp, Homo sapiens
gctaaagtccatccgccgctcc

SEQ ID NO: 7390 - DNA, 21 bp, Homo sapiens
ggaatttgttcagtctgcata

SEQ ID NO: 7391 - DNA, 20 bp, Homo sapiens
ccccggggggcagccatatc

SEQ ID NO: 7392 - DNA, 21 bp, Homo sapiens
acttcccaaacaagccactgc

SEQ ID NO: 7393 - DNA, 21 bp, Homo sapiens
gtccgcaccacggcgccatca

SEQ ID NO: 7394 - DNA, 21 bp, Homo sapiens
catgttcaacgtgaaaaagta

SEQ ID NO: 7395 - DNA, 21 bp, Homo sapiens
ctaaatcggccggcggcaggc

SEQ ID NO: 7396 - DNA, 21 bp, Homo sapiens
tagtggccggagtggccgctg

SEQ ID NO: 7397 - DNA, 20 bp, Homo sapiens
agttccctttcctgccaata

SEQ ID NO: 7398 - DNA, 21 bp, Homo sapiens
aggctgtgggaggcccagcat

SEQ ID NO: 7399 - DNA, 21 bp, Homo sapiens
gtggctggtgcacgacgagca

SEQ ID NO: 7400 - DNA, 20 bp, Homo sapiens
tgaggtgggaccagccgtaa

SEQ ID NO: 7401 - DNA, 22 bp, Homo sapiens
tcagccgctcagccgccgtgaa

SEQ ID NO: 7402 - DNA, 21 bp, Homo sapiens
tgacagaggacgaggtatggt

SEQ ID NO: 7403 - DNA, 21 bp, Homo sapiens
ttcccccctcctcccctctct

SEQ ID NO: 7404 - DNA, 21 bp, Homo sapiens
tgacctgccgctgtgctgaca

SEQ ID NO: 7405 - DNA, 21 bp, Homo sapiens
taaggccgctcgccactgtgg

SEQ ID NO: 7406 - DNA, 21 bp, Homo sapiens
catgagaagctcctgccgctg

SEQ ID NO: 7407 - DNA, 21 bp, Homo sapiens
ccacgcaggccgacaccatcg

SEQ ID NO: 7408 - DNA, 21 bp, Homo sapiens
ctgtcactacgcaacaacaga

SEQ ID NO: 7409 - DNA, 21 bp, Homo sapiens
catccagcgagctacggaaca

SEQ ID NO: 7410 - DNA, 23 bp, Homo sapiens
acatcaatttttacctgccaata

SEQ ID NO: 7411 - DNA, 21 bp, Homo sapiens
ttcatagcctcttccctggcc

SEQ ID NO: 7412 - DNA, 22 bp, Homo sapiens
tgctgggcgcggcctgcgccga

SEQ ID NO: 7413 - DNA, 21 bp, Homo sapiens
tgcacatcaattttccctggg

SEQ ID NO: 7414 - DNA, 21 bp, Homo sapiens
gacttgttgatgtgctgcgcc

SEQ ID NO: 7415 - DNA, 23 bp, Homo sapiens
ccctggccgctgacccccgccgt

SEQ ID NO: 7416 - DNA, 21 bp, Homo sapiens
ctcgcctctgggcctgcatcc

SEQ ID NO: 7417 - DNA, 23 bp, Homo sapiens
cccggcaggccggctgccagtga

SEQ ID NO: 7418 - DNA, 21 bp, Homo sapiens
ttcctccgtcgcgggcccgat

SEQ ID NO: 7419 - DNA, 21 bp, Homo sapiens
tagtcgctcccgtttcaccgg

SEQ ID NO: 7420 - DNA, 21 bp, Homo sapiens
cacagggagaccctggacgac

SEQ ID NO: 7421 - DNA, 21 bp, Homo sapiens
aaggaaaagggcctgccacaa

SEQ ID NO: 7422 - DNA, 22 bp, Homo sapiens
cagcagccgcaaccgccagcac

SEQ ID NO: 7423 - DNA, 21 bp, Homo sapiens
gagaggcgggtggcagcgctg

SEQ ID NO: 7424 - DNA, 21 bp, Homo sapiens
tcaatggctcggcaggccctg

SEQ ID NO: 7425 - DNA, 23 bp, Homo sapiens
agaatggctcgtactgcttctca

SEQ ID NO: 7426 - DNA, 21 bp, Homo sapiens
tggacgagctggcaggcccag

SEQ ID NO: 7427 - DNA, 23 bp, Homo sapiens
agtatatatcattccagccatag

SEQ ID NO: 7428 - DNA, 21 bp, Homo sapiens
ccttatcttctttttttaaat

SEQ ID NO: 7429 - DNA, 21 bp, Homo sapiens
ggtggacaaacgacgcacgag

SEQ ID NO: 7430 - DNA, 22 bp, Homo sapiens
cttgcggcggttgcagacatcg

SEQ ID NO: 7431 - DNA, 21 bp, Homo sapiens
gagtgcagcacgtaagagtct

SEQ ID NO: 7432 - DNA, 21 bp, Homo sapiens
agctgctgttatctgtacaaa

SEQ ID NO: 7433 - DNA, 22 bp, Homo sapiens
ctcacggcggttgttagtgtga

SEQ ID NO: 7434 - DNA, 21 bp, Homo sapiens
gaaagaacatcacacagttga

SEQ ID NO: 7435 - DNA, 21 bp, Homo sapiens
ctcccgctccgtcaggagctt

SEQ ID NO: 7436 - DNA, 21 bp, Homo sapiens
ccgcgctcaccggatgatcac

SEQ ID NO: 7437 - DNA, 21 bp, Homo sapiens
tcacccttcacttaagttcca

SEQ ID NO: 7438 - DNA, 21 bp, Homo sapiens
ggagactagaccccatggctt

SEQ ID NO: 7439 - DNA, 22 bp, Homo sapiens
ctggacaagcggcagccgctgg

SEQ ID NO: 7440 - DNA, 21 bp, Homo sapiens
tctctcacccgtccaccattg

SEQ ID NO: 7441 - DNA, 22 bp, Homo sapiens
atatggctggatgagcctctgc

SEQ ID NO: 7442 - DNA, 21 bp, Homo sapiens
gcactcacccgtaaacctggt

SEQ ID NO: 7443 - DNA, 21 bp, Homo sapiens
cacggggttgttgttacaggg

SEQ ID NO: 7444 - DNA, 21 bp, Homo sapiens
aacgtgctgtgcagagaggcc

SEQ ID NO: 7445 - DNA, 21 bp, Homo sapiens
accgagcctgctgccttctca

SEQ ID NO: 7446 - DNA, 21 bp, Homo sapiens
acagccacgaggaaggtaggc

SEQ ID NO: 7447 - DNA, 21 bp, Homo sapiens
ctccccaaacgtcaactgcct

SEQ ID NO: 7448 - DNA, 21 bp, Homo sapiens
ccactgtcgcgcctgtgactg

SEQ ID NO: 7449 - DNA, 21 bp, Homo sapiens
acttcccaaacaagccactgc

SEQ ID NO: 7450 - DNA, 23 bp, Homo sapiens
gtgcagcagcactccgccagcca

SEQ ID NO: 7451 - DNA, 22 bp, Homo sapiens
cttgtggcttgattgcaaagtc

SEQ ID NO: 7452 - DNA, 21 bp, Homo sapiens
ttgggatatacctgtaagtgt

SEQ ID NO: 7453 - DNA, 21 bp, Homo sapiens
ccagatggcgggctccattca

SEQ ID NO: 7454 - DNA, 21 bp, Homo sapiens
atcccaggggaacccaggacc

SEQ ID NO: 7455 - DNA, 22 bp, Homo sapiens
agagaggctgctgtgcgactca

SEQ ID NO: 7456 - DNA, 21 bp, Homo sapiens
agaccctggacgacgtcctgc

SEQ ID NO: 7457 - DNA, 21 bp, Homo sapiens
acactggtgagaagccactca

SEQ ID NO: 7458 - DNA, 23 bp, Homo sapiens
ccctgggtgctcacccgccggta

SEQ ID NO: 7459 - DNA, 21 bp, Homo sapiens
gacccacctgcgtgatgcagg

SEQ ID NO: 7460 - DNA, 21 bp, Homo sapiens
acaagatagatgagcaagacc

SEQ ID NO: 7461 - DNA, 21 bp, Homo sapiens
gcgccgaggggctgccgctgc

SEQ ID NO: 7462 - DNA, 22 bp, Homo sapiens
ctttcattggacgagccaatca

SEQ ID NO: 7463 - DNA, 21 bp, Homo sapiens
tgcgccttggcgctaaacgaa

SEQ ID NO: 7464 - DNA, 22 bp, Homo sapiens
ccccagccgcggctgccgcact

SEQ ID NO: 7465 - DNA, 21 bp, Homo sapiens
gcgctgcttctccccgccgct

SEQ ID NO: 7466 - DNA, 22 bp, Homo sapiens
ctactgtggctgcagccactgg

SEQ ID NO: 7467 - DNA, 21 bp, Homo sapiens
aagagccacagccccccttgg

SEQ ID NO: 7468 - DNA, 21 bp, Homo sapiens
agaggagggtggaaatgaagg

SEQ ID NO: 7469 - DNA, 22 bp, Homo sapiens
atggacagcctgcagccgctcc

SEQ ID NO: 7470 - DNA, 21 bp, Homo sapiens
tcgggcagggcgcggctctcg

SEQ ID NO: 7471 - DNA, 21 bp, Homo sapiens
ccaggtgagcggctgcctgag

SEQ ID NO: 7472 - DNA, 22 bp, Homo sapiens
aggctggcggacgtggtcgcca

SEQ ID NO: 7473 - DNA, 21 bp, Homo sapiens
ctccacagccgccctggacac

SEQ ID NO: 7474 - DNA, 21 bp, Homo sapiens
ccctcatccgacagccgatac

SEQ ID NO: 7475 - DNA, 21 bp, Homo sapiens
gcggctccacggctgggggct

SEQ ID NO: 7476 - DNA, 21 bp, Homo sapiens
ctttcataccgctccacaaat

SEQ ID NO: 7477 - DNA, 21 bp, Homo sapiens
aaatctggcccacaagtcata

SEQ ID NO: 7478 - DNA, 21 bp, Homo sapiens
gtaaaactcctccaggcagct

SEQ ID NO: 7479 - DNA, 21 bp, Homo sapiens
actgagagctcgagagcatgg

SEQ ID NO: 7480 - DNA, 21 bp, Homo sapiens
gcttggcgtcgttggccatca

SEQ ID NO: 7481 - DNA, 21 bp, Homo sapiens
gctccacggctttctggctgc

SEQ ID NO: 7482 - DNA, 21 bp, Homo sapiens
ctccacggctttctggctgcc

SEQ ID NO: 7483 - DNA, 21 bp, Homo sapiens
tggccatggtcaaggctatac

SEQ ID NO: 7484 - DNA, 21 bp, Homo sapiens
tacctattctctgtctgtcat

SEQ ID NO: 7485 - DNA, 21 bp, Homo sapiens
acctattctctgtctgtcata

SEQ ID NO: 7486 - DNA, 21 bp, Homo sapiens
ccaggtatgggccttcggaag

SEQ ID NO: 7487 - DNA, 21 bp, Homo sapiens
tgcaaaggtaagagagggtgt

SEQ ID NO: 7488 - DNA, 21 bp, Homo sapiens
tgcacagccaggtggtcctcc

SEQ ID NO: 7489 - DNA, 21 bp, Homo sapiens
cgacggctgccacagtgatga

SEQ ID NO: 7490 - DNA, 21 bp, Homo sapiens
gccccaatgcctacttcttcg

SEQ ID NO: 7491 - DNA, 21 bp, Homo sapiens
ttcacggccagcttccgcagg

SEQ ID NO: 7492 - DNA, 21 bp, Homo sapiens
gcactgtggtgacaatgagtg

SEQ ID NO: 7493 - DNA, 21 bp, Homo sapiens
cagcactgtggtgacaatgag

SEQ ID NO: 7494 - DNA, 21 bp, Homo sapiens
gcatgtgtaatctcctaggag

SEQ ID NO: 7495 - DNA, 21 bp, Homo sapiens
aatggaagtatcctttttttg

SEQ ID NO: 7496 - DNA, 21 bp, Homo sapiens
aagcaggtaggagaggtccag

SEQ ID NO: 7497 - DNA, 21 bp, Homo sapiens
ttaatcccactgtggccctcg

SEQ ID NO: 7498 - DNA, 21 bp, Homo sapiens
ctctcacctttccggatgggt

SEQ ID NO: 7499 - DNA, 21 bp, Homo sapiens
cccctggcgtgtcgccagccc

SEQ ID NO: 7500 - DNA, 21 bp, Homo sapiens
ctatgacaccagtggccagcg

SEQ ID NO: 7501 - DNA, 21 bp, Homo sapiens
gggagaccgtggagggtatct

SEQ ID NO: 7502 - DNA, 21 bp, Homo sapiens
ggagaccgtggagggtatctc

SEQ ID NO: 7503 - DNA, 21 bp, Homo sapiens
cagctgctgcagaagagcatc

SEQ ID NO: 7504 - DNA, 21 bp, Homo sapiens
ccaattccaccaatgcagggg

SEQ ID NO: 7505 - DNA, 21 bp, Homo sapiens
tacagaaccccctggcagcca

SEQ ID NO: 7506 - DNA, 21 bp, Homo sapiens
ctggtggtgggaaatccggga

SEQ ID NO: 7507 - DNA, 21 bp, Homo sapiens
cacgcagtcatggtagctctc

SEQ ID NO: 7508 - DNA, 21 bp, Homo sapiens
tccagccccaacctgcaggtg

SEQ ID NO: 7509 - DNA, 21 bp, Homo sapiens
ctgttgaggggcgtcttccaa

SEQ ID NO: 7510 - DNA, 21 bp, Homo sapiens
gctgcagtgcctccagctcct

SEQ ID NO: 7511 - DNA, 21 bp, Homo sapiens
atggtgatatcccttctgtga

SEQ ID NO: 7512 - DNA, 21 bp, Homo sapiens
gcaccaagtgttgctgcagga

SEQ ID NO: 7513 - DNA, 21 bp, Homo sapiens
ctgcaccgggaaccagcagag

SEQ ID NO: 7514 - DNA, 21 bp, Homo sapiens
gtctgagggcaccaaggctgt

SEQ ID NO: 7515 - DNA, 21 bp, Homo sapiens
ggttgaggtctcacatgtggc

SEQ ID NO: 7516 - DNA, 21 bp, Homo sapiens
cagtgctggcagtggccacag

SEQ ID NO: 7517 - DNA, 21 bp, Homo sapiens
gcttgaagctgtcgtctatgt

SEQ ID NO: 7518 - DNA, 21 bp, Homo sapiens
gttccggctgcgcgatgagtt

SEQ ID NO: 7519 - DNA, 21 bp, Homo sapiens
ttccggctgcgcgatgagttc

SEQ ID NO: 7520 - DNA, 21 bp, Homo sapiens
aatctggcatgaaggacatca

SEQ ID NO: 7521 - DNA, 21 bp, Homo sapiens
tgaacattgcgcctggaccaa

SEQ ID NO: 7522 - DNA, 21 bp, Homo sapiens
ccccaacacagccatgcccag

SEQ ID NO: 7523 - DNA, 21 bp, Homo sapiens
cagcgcttccggcagtacctg

SEQ ID NO: 7524 - DNA, 21 bp, Homo sapiens
ggggcaacgacgagaagaaga

SEQ ID NO: 7525 - DNA, 21 bp, Homo sapiens
accctgccccgctctggggtc

SEQ ID NO: 7526 - DNA, 21 bp, Homo sapiens
ccctgccccgctctggggtcc

SEQ ID NO: 7527 - DNA, 21 bp, Homo sapiens
cgggcttccgatccccaaaga

SEQ ID NO: 7528 - DNA, 21 bp, Homo sapiens
ccacgcaggacatccacaggc

SEQ ID NO: 7529 - DNA, 21 bp, Homo sapiens
gactcttgtcaagagagaggg

SEQ ID NO: 7530 - DNA, 21 bp, Homo sapiens
tgccccagtgcactgagatgc

SEQ ID NO: 7531 - DNA, 21 bp, Homo sapiens
aatctcaccatcacctctcca

SEQ ID NO: 7532 - DNA, 21 bp, Homo sapiens
gctggcggggcgcccacggcc

SEQ ID NO: 7533 - DNA, 21 bp, Homo sapiens
gcgacaacaaggccttcaatg

SEQ ID NO: 7534 - DNA, 21 bp, Homo sapiens
ttattccatcagcttgaccca

SEQ ID NO: 7535 - DNA, 21 bp, Homo sapiens
aaaaattggatttcgaaaaaa

SEQ ID NO: 7536 - DNA, 21 bp, Homo sapiens
gaggagggggccgacgccgtg

SEQ ID NO: 7537 - DNA, 21 bp, Homo sapiens
tacggcagcagcacgaggtga

SEQ ID NO: 7538 - DNA, 21 bp, Homo sapiens
ctggtgggggcgagactgttt

SEQ ID NO: 7539 - DNA, 20 bp, Homo sapiens
tggcggggggcagccgagac

SEQ ID NO: 7540 - DNA, 21 bp, Homo sapiens
caggaagcggcgggaaaaggc

SEQ ID NO: 7541 - DNA, 21 bp, Homo sapiens
ctccccagttcttttggagga

SEQ ID NO: 7542 - DNA, 21 bp, Homo sapiens
atgtgaatgaacctgccacaa

SEQ ID NO: 7543 - DNA, 21 bp, Homo sapiens
cagcagcagctgccacagcag

SEQ ID NO: 7544 - DNA, 21 bp, Homo sapiens
aggcacaagaaaatgtggact

SEQ ID NO: 7545 - DNA, 21 bp, Homo sapiens
tctttgtggcgtccagacagg

SEQ ID NO: 7546 - DNA, 21 bp, Homo sapiens
taccggctggtacacaaggat

SEQ ID NO: 7547 - DNA, 22 bp, Homo sapiens
cagaggcggctgccgccgacac

SEQ ID NO: 7548 - DNA, 21 bp, Homo sapiens
taccatggccgaagacgcaga

SEQ ID NO: 7549 - DNA, 21 bp, Homo sapiens
ccagtggcttcctctgtctcc

SEQ ID NO: 7550 - DNA, 21 bp, Homo sapiens
gttggcggccgtggggtgcca

SEQ ID NO: 7551 - DNA, 21 bp, Homo sapiens
ggcgaactgtgagcactggtc

SEQ ID NO: 7552 - DNA, 21 bp, Homo sapiens
aaataagagacctgaaagaaa

SEQ ID NO: 7553 - DNA, 21 bp, Homo sapiens
ccagtggcggcggcggcagcc

SEQ ID NO: 7554 - DNA, 21 bp, Homo sapiens
aaagacttgtctcgatcaatc

SEQ ID NO: 7555 - DNA, 21 bp, Homo sapiens
aaggtctgccgaagccttggc

SEQ ID NO: 7556 - DNA, 21 bp, Homo sapiens
acctttgtcaaggtgtggccc

SEQ ID NO: 7557 - DNA, 22 bp, Homo sapiens
cttatggcttcatcgctggggc

SEQ ID NO: 7558 - DNA, 21 bp, Homo sapiens
ggccgagttcccctccgccaa

SEQ ID NO: 7559 - DNA, 23 bp, Homo sapiens
actggctgggtgaggctggccct

SEQ ID NO: 7560 - DNA, 21 bp, Homo sapiens
gtatggcgggagctgctggcc

SEQ ID NO: 7561 - DNA, 21 bp, Homo sapiens
aacaacttccacagcctctac

SEQ ID NO: 7562 - DNA, 21 bp, Homo sapiens
agcccctccttctcctccact

SEQ ID NO: 7563 - DNA, 21 bp, Homo sapiens
ggcagagcgcgtgtttctggt

SEQ ID NO: 7564 - DNA, 21 bp, Homo sapiens
gccacatcccgtgatggaaac

SEQ ID NO: 7565 - DNA, 21 bp, Homo sapiens
tcagatgggaacaccaagtac

SEQ ID NO: 7566 - DNA, 23 bp, Homo sapiens
cttcggagtccgcgagccgtacc

SEQ ID NO: 7567 - DNA, 22 bp, Homo sapiens
ggctggggggctggtggcgcca

SEQ ID NO: 7568 - DNA, 21 bp, Homo sapiens
tgttaaatttctattatcttt

SEQ ID NO: 7569 - DNA, 21 bp, Homo sapiens
aggccgagggcgcggcgacgg

SEQ ID NO: 7570 - DNA, 20 bp, Homo sapiens
ttggaggggcgggtgcccca

SEQ ID NO: 7571 - DNA, 21 bp, Homo sapiens
gctgtgaccccgatggcgttc

SEQ ID NO: 7572 - DNA, 21 bp, Homo sapiens
attcccgggacgcaaagtaat

SEQ ID NO: 7573 - DNA, 23 bp, Homo sapiens
cgaggaggaaggggaggaggagg

SEQ ID NO: 7574 - DNA, 21 bp, Homo sapiens
gtagtggctgtagtcgcggga

SEQ ID NO: 7575 - DNA, 21 bp, Homo sapiens
ctcccttgccgttttccgagc

SEQ ID NO: 7576 - DNA, 23 bp, Homo sapiens
accggctctgctcggggagccgc

SEQ ID NO: 7577 - DNA, 21 bp, Homo sapiens
gcttcacgtgcggattggtgg

SEQ ID NO: 7578 - DNA, 21 bp, Homo sapiens
ccaccttgtcgtgtgtgagct

SEQ ID NO: 7579 - DNA, 21 bp, Homo sapiens
tggggcccaggtgagcctggt

SEQ ID NO: 7580 - DNA, 21 bp, Homo sapiens
agtgccagccgaggcctcgct

SEQ ID NO: 7581 - DNA, 21 bp, Homo sapiens
tttcttagagggatcaccttt

SEQ ID NO: 7582 - DNA, 21 bp, Homo sapiens
ggctcggctcgccagcgggct

SEQ ID NO: 7583 - DNA, 21 bp, Homo sapiens
gaaaaagagacgaagagctca

SEQ ID NO: 7584 - DNA, 22 bp, Homo sapiens
gatgtggctgttgggcttcgaa

SEQ ID NO: 7585 - DNA, 22 bp, Homo sapiens
accccgagggacgagccgatgt

SEQ ID NO: 7586 - DNA, 21 bp, Homo sapiens
ccccaccgggggcagcaagga

SEQ ID NO: 7587 - DNA, 21 bp, Homo sapiens
ccaggtggcggcagccactgt

SEQ ID NO: 7588 - DNA, 21 bp, Homo sapiens
tcaaatccaaatatacaaaag

SEQ ID NO: 7589 - DNA, 21 bp, Homo sapiens
ccaacagagtgtccaagacac

SEQ ID NO: 7590 - DNA, 21 bp, Homo sapiens
caacctcctcgtctttgtcgt

SEQ ID NO: 7591 - DNA, 21 bp, Homo sapiens
tctcccagggcagccatctgg

SEQ ID NO: 7592 - DNA, 21 bp, Homo sapiens
ggttggctggcgtggggcttg

SEQ ID NO: 7593 - DNA, 22 bp, Homo sapiens
tggctgggggacgcgtcggggt

SEQ ID NO: 7594 - DNA, 21 bp, Homo sapiens
agccgcacacgccaggcctga

SEQ ID NO: 7595 - DNA, 22 bp, Homo sapiens
cagggtccacagcccccgccat

SEQ ID NO: 7596 - DNA, 21 bp, Homo sapiens
agaacggctcggcgccttgca

SEQ ID NO: 7597 - DNA, 21 bp, Homo sapiens
cctgcagagcgcctcccaccg

SEQ ID NO: 7598 - DNA, 23 bp, Homo sapiens
ctaggcaaggagaaggagcccct

SEQ ID NO: 7599 - DNA, 21 bp, Homo sapiens
tctggtccttcccctctccag

SEQ ID NO: 7600 - DNA, 21 bp, Homo sapiens
ctctggtccttcccctctcca

SEQ ID NO: 7601 - DNA, 21 bp, Homo sapiens
cctctggtccttcccctctcc

SEQ ID NO: 7602 - DNA, 21 bp, Homo sapiens
ccccctggctgctccttctct

SEQ ID NO: 7603 - DNA, 21 bp, Homo sapiens
tgcacacagatctcatcactc

SEQ ID NO: 7604 - DNA, 21 bp, Homo sapiens
tgagggcgggcgtcatggcgt

SEQ ID NO: 7605 - DNA, 21 bp, Homo sapiens
cgcttcttccggaacctctgt

SEQ ID NO: 7606 - DNA, 21 bp, Homo sapiens
ctttccatctttgactaaagc

SEQ ID NO: 7607 - DNA, 21 bp, Homo sapiens
ccccctcatgagccccctttc

SEQ ID NO: 7608 - DNA, 21 bp, Homo sapiens
gcggctgtggtggtggtggtg

SEQ ID NO: 7609 - DNA, 21 bp, Homo sapiens
tgtgactggccaagccgtagt

SEQ ID NO: 7610 - DNA, 20 bp, Homo sapiens
agaagtggctggaaatgaac

SEQ ID NO: 7611 - DNA, 21 bp, Homo sapiens
gggctgggaggctgccactga

SEQ ID NO: 7612 - DNA, 22 bp, Homo sapiens
ttcggaaatcagccagccagtc

SEQ ID NO: 7613 - DNA, 21 bp, Homo sapiens
gcgcacgtgtgcgctgcctgc

SEQ ID NO: 7614 - DNA, 21 bp, Homo sapiens
ctaccacatcgcccagtacac

SEQ ID NO: 7615 - DNA, 21 bp, Homo sapiens
ccgcagtactcgcacgtgtcg

SEQ ID NO: 7616 - DNA, 21 bp, Homo sapiens
agggatctcagtgacatccta

SEQ ID NO: 7617 - DNA, 21 bp, Homo sapiens
ccgggccagctccagccgcac

SEQ ID NO: 7618 - DNA, 21 bp, Homo sapiens
cccactgcgaccatgttcgtt

SEQ ID NO: 7619 - DNA, 23 bp, Homo sapiens
cgggcaggtcgagcccgccgttc

SEQ ID NO: 7620 - DNA, 21 bp, Homo sapiens
ccggagcaggaatacctcctc

SEQ ID NO: 7621 - DNA, 21 bp, Homo sapiens
ccctctgcacacctgccacaa

SEQ ID NO: 7622 - DNA, 21 bp, Homo sapiens
gcaccagcccgatgcacacgc

SEQ ID NO: 7623 - DNA, 22 bp, Homo sapiens
gtggcgggggtcgcgaggccgc

SEQ ID NO: 7624 - DNA, 21 bp, Homo sapiens
ccaggtgacaccgggtctagg

SEQ ID NO: 7625 - DNA, 21 bp, Homo sapiens
atagggaatcccttctactta

SEQ ID NO: 7626 - DNA, 21 bp, Homo sapiens
agggctgaaggagaagtggga

SEQ ID NO: 7627 - DNA, 21 bp, Homo sapiens
caggtctggacgccagcccac

SEQ ID NO: 7628 - DNA, 21 bp, Homo sapiens
cccagacacaggcaccgtgcc

SEQ ID NO: 7629 - DNA, 21 bp, Homo sapiens
aataataagtcgtagaagtcg

SEQ ID NO: 7630 - DNA, 23 bp, Homo sapiens
ccacgtgggcgggctgccgctgc

SEQ ID NO: 7631 - DNA, 21 bp, Homo sapiens
cttcttctctgtaaacagcgg

SEQ ID NO: 7632 - DNA, 21 bp, Homo sapiens
tgggagcatgcgctcacacaa

SEQ ID NO: 7633 - DNA, 21 bp, Homo sapiens
tcagggttcccaggcacagga

SEQ ID NO: 7634 - DNA, 21 bp, Homo sapiens
aatctggcccacaagtcatac

SEQ ID NO: 7635 - DNA, 21 bp, Homo sapiens
cgctggacccggacgcagccc

SEQ ID NO: 7636 - DNA, 21 bp, Homo sapiens
ctattctctgtctgtcatatc

SEQ ID NO: 7637 - DNA, 21 bp, Homo sapiens
cctttcccccaccccacaccc

SEQ ID NO: 7638 - DNA, 21 bp, Homo sapiens
gcacattcgataaaggatatg

SEQ ID NO: 7639 - DNA, 21 bp, Homo sapiens
aagatggggagatgttcatgc

SEQ ID NO: 7640 - DNA, 21 bp, Homo sapiens
attacttacctggggcggaga

SEQ ID NO: 7641 - DNA, 21 bp, Homo sapiens
cattacttacctggggcggag

SEQ ID NO: 7642 - DNA, 21 bp, Homo sapiens
cagcctgcattgatgcacagg

SEQ ID NO: 7643 - DNA, 21 bp, Homo sapiens
ggcccgaacaagaaagggtag

SEQ ID NO: 7644 - DNA, 21 bp, Homo sapiens
tcctgctccccttcactgaaa

SEQ ID NO: 7645 - DNA, 21 bp, Homo sapiens
taccagcactgtggtgacaat

SEQ ID NO: 7646 - DNA, 21 bp, Homo sapiens
agcaggtaggagaggtccaga

SEQ ID NO: 7647 - DNA, 21 bp, Homo sapiens
accacaatacccgcaccacca

SEQ ID NO: 7648 - DNA, 21 bp, Homo sapiens
tttaatcccactgtggccctc

SEQ ID NO: 7649 - DNA, 21 bp, Homo sapiens
atacagctcgtccaaaggctc

SEQ ID NO: 7650 - DNA, 21 bp, Homo sapiens
cggagtgttcgtggtgtgctg

SEQ ID NO: 7651 - DNA, 21 bp, Homo sapiens
ctggcgtgtcgccagccccct

SEQ ID NO: 7652 - DNA, 21 bp, Homo sapiens
tggctccatccctgtctccag

SEQ ID NO: 7653 - DNA, 21 bp, Homo sapiens
cttcaggtctgagaggcaggc

SEQ ID NO: 7654 - DNA, 21 bp, Homo sapiens
aactggccctgaccagccgct

SEQ ID NO: 7655 - DNA, 21 bp, Homo sapiens
tgccttaccagaggagactct

SEQ ID NO: 7656 - DNA, 21 bp, Homo sapiens
ctaagctctgctcctccctgg

SEQ ID NO: 7657 - DNA, 21 bp, Homo sapiens
tggtggtgggaaatccgggaa

SEQ ID NO: 7658 - DNA, 21 bp, Homo sapiens
accactttatggtttcatctg

SEQ ID NO: 7659 - DNA, 21 bp, Homo sapiens
caccaagtgttgctgcaggag

SEQ ID NO: 7660 - DNA, 21 bp, Homo sapiens
tggagacactgtgtatggctg

SEQ ID NO: 7661 - DNA, 21 bp, Homo sapiens
ttcatggtcattttttcttgt

SEQ ID NO: 7662 - DNA, 21 bp, Homo sapiens
caggtcttctcggtttttcat

SEQ ID NO: 7663 - DNA, 21 bp, Homo sapiens
ccgcccaggacgcagagggcc

SEQ ID NO: 7664 - DNA, 21 bp, Homo sapiens
cagtgagcacggtacattgga

SEQ ID NO: 7665 - DNA, 21 bp, Homo sapiens
ggttggtgtcctcaaagagcc

SEQ ID NO: 7666 - DNA, 22 bp, Homo sapiens
ataggcagggtcggtcacacag

SEQ ID NO: 7667 - DNA, 21 bp, Homo sapiens
tagtacagaccaaccatggag

SEQ ID NO: 7668 - DNA, 21 bp, Homo sapiens
cttgaagctgtcgtctatgtt

SEQ ID NO: 7669 - DNA, 21 bp, Homo sapiens
tattttccagaaatggaaaga

SEQ ID NO: 7670 - DNA, 21 bp, Homo sapiens
ttgaagctgtcgtctatgttg

SEQ ID NO: 7671 - DNA, 21 bp, Homo sapiens
cagttccggctgcgcgatgag

SEQ ID NO: 7672 - DNA, 21 bp, Homo sapiens
agttccggctgcgcgatgagt

SEQ ID NO: 7673 - DNA, 21 bp, Homo sapiens
ctcgctggccacccacagcgc

SEQ ID NO: 7674 - DNA, 21 bp, Homo sapiens
gcagcgcttccggcagtacct

SEQ ID NO: 7675 - DNA, 21 bp, Homo sapiens
tccgagatccccccctccagc

SEQ ID NO: 7676 - DNA, 21 bp, Homo sapiens
ggcttccgatccccaaagatc

SEQ ID NO: 7677 - DNA, 21 bp, Homo sapiens
cctggggctctgggcccaccc

SEQ ID NO: 7678 - DNA, 21 bp, Homo sapiens
atggtcaacgtcctcgggggc

SEQ ID NO: 7679 - DNA, 21 bp, Homo sapiens
gaaagtttcagtcctccaggg

SEQ ID NO: 7680 - DNA, 21 bp, Homo sapiens
gggtccttccatcctgcactg

SEQ ID NO: 7681 - DNA, 21 bp, Homo sapiens
ggactcttgtcaagagagagg

SEQ ID NO: 7682 - DNA, 21 bp, Homo sapiens
ctggtgctgcccaaccgtgtg

SEQ ID NO: 7683 - DNA, 21 bp, Homo sapiens
ccagctgatccagctggtgtg

SEQ ID NO: 7684 - DNA, 21 bp, Homo sapiens
gttggtagacccggggcgggg

SEQ ID NO: 7685 - DNA, 21 bp, Homo sapiens
gttcccactcgatgtgccctg

SEQ ID NO: 7686 - DNA, 21 bp, Homo sapiens
ggcaggacctacaagggatga

SEQ ID NO: 7687 - DNA, 21 bp, Homo sapiens
ttctatcttactctgctgcag

SEQ ID NO: 7688 - DNA, 21 bp, Homo sapiens
ctgccagcgctctgtccacag

SEQ ID NO: 7689 - DNA, 21 bp, Homo sapiens
attggaaaaagtggcttcttt

SEQ ID NO: 7690 - DNA, 21 bp, Homo sapiens
tattccatcagcttgacccag

SEQ ID NO: 7691 - DNA, 21 bp, Homo sapiens
tttattccatcagcttgaccc

SEQ ID NO: 7692 - DNA, 21 bp, Homo sapiens
aggagggggccgacgccgtgc

SEQ ID NO: 7693 - DNA, 21 bp, Homo sapiens
agccgaacagggccacaagga

SEQ ID NO: 7694 - DNA, 21 bp, Homo sapiens
cgatggctcctaccaaaacag

SEQ ID NO: 7695 - DNA, 21 bp, Homo sapiens
cgtaggcctcgctgacttggc

SEQ ID NO: 7696 - DNA, 21 bp, Homo sapiens
gatctcgcgtaccagccgctg

SEQ ID NO: 7697 - DNA, 21 bp, Homo sapiens
gttctctcaatacataaagaa

SEQ ID NO: 7698 - DNA, 21 bp, Homo sapiens
ataaaaacttcgacattactg

SEQ ID NO: 7699 - DNA, 21 bp, Homo sapiens
ccaccggtttgagaagatcag

SEQ ID NO: 7700 - DNA, 21 bp, Homo sapiens
tcccaggcccgcgtacctgca

SEQ ID NO: 7701 - DNA, 21 bp, Homo sapiens
ttcagatccatgtataataac

SEQ ID NO: 7702 - DNA, 21 bp, Homo sapiens
ctcacggacgcgtacggctgc

SEQ ID NO: 7703 - DNA, 21 bp, Homo sapiens
ttttttttttagtttggatta

SEQ ID NO: 7704 - DNA, 21 bp, Homo sapiens
tcattggctgccccccaggca

SEQ ID NO: 7705 - DNA, 21 bp, Homo sapiens
ggaagcagccgcccgtcttgg

SEQ ID NO: 7706 - DNA, 23 bp, Homo sapiens
gagtggctggaatgggaggaccg

SEQ ID NO: 7707 - DNA, 21 bp, Homo sapiens
aggggctgggcagctctcaga

SEQ ID NO: 7708 - DNA, 20 bp, Homo sapiens
tgacccggcaggcctggccg

SEQ ID NO: 7709 - DNA, 22 bp, Homo sapiens
acagtgccacagcccagccaca

SEQ ID NO: 7710 - DNA, 23 bp, Homo sapiens
aaatacggctgccggcgcagacg

SEQ ID NO: 7711 - DNA, 21 bp, Homo sapiens
gggcgaggaggaaggggagga

SEQ ID NO: 7712 - DNA, 21 bp, Homo sapiens
ttcctccgtcgcgggcccgat

SEQ ID NO: 7713 - DNA, 21 bp, Homo sapiens
cggcccgtgccgtcatccacc

SEQ ID NO: 7714 - DNA, 21 bp, Homo sapiens
cggagacctggacgccctgga

SEQ ID NO: 7715 - DNA, 21 bp, Homo sapiens
cggctggaagcggaaggagct

SEQ ID NO: 7716 - DNA, 21 bp, Homo sapiens
ctactacaagaagacgaccaa

SEQ ID NO: 7717 - DNA, 21 bp, Homo sapiens
cgtgagggccggcactgagga

SEQ ID NO: 7718 - DNA, 21 bp, Homo sapiens
tttgcctccataggggagagg

SEQ ID NO: 7719 - DNA, 21 bp, Homo sapiens
gtaaggatccccaatgatgcg

SEQ ID NO: 7720 - DNA, 20 bp, Homo sapiens
gggcagtggcttgggcacct

SEQ ID NO: 7721 - DNA, 23 bp, Homo sapiens
gggcatgttcatgcccaccagcc

SEQ ID NO: 7722 - DNA, 21 bp, Homo sapiens
gagaggcaggtgagggcagcc

SEQ ID NO: 7723 - DNA, 21 bp, Homo sapiens
ctgcggcaggagggcttctcc

SEQ ID NO: 7724 - DNA, 21 bp, Homo sapiens
gagaggctggaggaggggtgg

SEQ ID NO: 7725 - DNA, 21 bp, Homo sapiens
ctgcaggcagcgagccatgaa

SEQ ID NO: 7726 - DNA, 21 bp, Homo sapiens
catcatcagggacccaggtag

SEQ ID NO: 7727 - DNA, 21 bp, Homo sapiens
ttgcggcgggcggcgtggatg

SEQ ID NO: 7728 - DNA, 21 bp, Homo sapiens
gggccatggcgagaatgtcta

SEQ ID NO: 7729 - DNA, 21 bp, Homo sapiens
gccccctggctgctccttctc

SEQ ID NO: 7730 - DNA, 21 bp, Homo sapiens
caggatggctctggcgatcca

SEQ ID NO: 7731 - DNA, 21 bp, Homo sapiens
ggcgcctgcccaggacgtacc

SEQ ID NO: 7732 - DNA, 21 bp, Homo sapiens
tggatgactgcgagagagcac

SEQ ID NO: 7733 - DNA, 21 bp, Homo sapiens
cagcggcgggagcggctgctt

SEQ ID NO: 7734 - DNA, 21 bp, Homo sapiens
cgaaaacccagccccgcctct

SEQ ID NO: 7735 - DNA, 20 bp, Homo sapiens
tttagaggctggtttatctg

SEQ ID NO: 7736 - DNA, 21 bp, Homo sapiens
ctcccccagagcaccagccac

SEQ ID NO: 7737 - DNA, 20 bp, Homo sapiens
cctcgtggctggccccgagg

SEQ ID NO: 7738 - DNA, 21 bp, Homo sapiens
agtactcggcacccgccactt

SEQ ID NO: 7739 - DNA, 21 bp, Homo sapiens
atgaggatcacgtggtcatcg

SEQ ID NO: 7740 - DNA, 22 bp, Homo sapiens
cactggcgggatggccagggct

SEQ ID NO: 7741 - DNA, 21 bp, Homo sapiens
acagggcctcggcaatgtcgg

SEQ ID NO: 7742 - DNA, 21 bp, Homo sapiens
cctatcacagacttgaaattg

SEQ ID NO: 7743 - DNA, 21 bp, Homo sapiens
taaagtagatataggtgaagc

SEQ ID NO: 7744 - DNA, 21 bp, Homo sapiens
tgaacttcagcgggggcctcc

SEQ ID NO: 7745 - DNA, 21 bp, Homo sapiens
cactggcacgtgtagctgccg

SEQ ID NO: 7746 - DNA, 21 bp, Homo sapiens
ggatctggccgttggccagca

SEQ ID NO: 7747 - DNA, 21 bp, Homo sapiens
acttgcaaaagaagtatgtaa

SEQ ID NO: 7748 - DNA, 22 bp, Homo sapiens
gcccaggctctgcagccacatc

SEQ ID NO: 7749 - DNA, 21 bp, Homo sapiens
agcagctcacgcccgctgggg

SEQ ID NO: 7750 - DNA, 21 bp, Homo sapiens
gagaaacctggtcgtgtccgt

SEQ ID NO: 7751 - DNA, 21 bp, Homo sapiens
catagcccgtcggggtcactg

SEQ ID NO: 7752 - DNA, 21 bp, Homo sapiens
cgctccacggctttctggctg

SEQ ID NO: 7753 - DNA, 21 bp, Homo sapiens
ggggccccttgtgcttggcga

SEQ ID NO: 7754 - DNA, 21 bp, Homo sapiens
ccactggctcgggggatgtgc

SEQ ID NO: 7755 - DNA, 21 bp, Homo sapiens
tggagtgtgacgacaccccca

SEQ ID NO: 7756 - DNA, 21 bp, Homo sapiens
accaggtatgggccttcggaa

SEQ ID NO: 7757 - DNA, 21 bp, Homo sapiens
atgatgatgaagcctgaactg

SEQ ID NO: 7758 - DNA, 21 bp, Homo sapiens
tgatgatgaagcctgaactgg

SEQ ID NO: 7759 - DNA, 21 bp, Homo sapiens
gacggctgccacagtgatgac

SEQ ID NO: 7760 - DNA, 21 bp, Homo sapiens
agcacattcgataaaggatat

SEQ ID NO: 7761 - DNA, 21 bp, Homo sapiens
ccaatgcctacttcttcgctg

SEQ ID NO: 7762 - DNA, 21 bp, Homo sapiens
atggccatggacttgagtggg

SEQ ID NO: 7763 - DNA, 21 bp, Homo sapiens
ctcctcgatgtagcgagatgt

SEQ ID NO: 7764 - DNA, 21 bp, Homo sapiens
gagagccttctgctgcaggac

SEQ ID NO: 7765 - DNA, 21 bp, Homo sapiens
tggcatcttagtgccccctga

SEQ ID NO: 7766 - DNA, 21 bp, Homo sapiens
ttggcaggacagcttgaggtt

SEQ ID NO: 7767 - DNA, 21 bp, Homo sapiens
ggcctcctcacctgtgatgct

SEQ ID NO: 7768 - DNA, 21 bp, Homo sapiens
tttttaatcccactgtggccc

SEQ ID NO: 7769 - DNA, 21 bp, Homo sapiens
tctttttaatcccactgtggc

SEQ ID NO: 7770 - DNA, 21 bp, Homo sapiens
caggcctcctcacctgtgatg

SEQ ID NO: 7771 - DNA, 21 bp, Homo sapiens
gagagaatgagctggtgttcg

SEQ ID NO: 7772 - DNA, 21 bp, Homo sapiens
agagaatgagctggtgttcgg

SEQ ID NO: 7773 - DNA, 21 bp, Homo sapiens
gagaatgagctggtgttcggg

SEQ ID NO: 7774 - DNA, 21 bp, Homo sapiens
gtggaggccactcagctcctc

SEQ ID NO: 7775 - DNA, 21 bp, Homo sapiens
ttcaggtctgagaggcaggca

SEQ ID NO: 7776 - DNA, 21 bp, Homo sapiens
agcctctgcgccgcatgctgc

SEQ ID NO: 7777 - DNA, 21 bp, Homo sapiens
tcaggtctgagaggcaggcag

SEQ ID NO: 7778 - DNA, 21 bp, Homo sapiens
cgagtggctcggagccttcat

SEQ ID NO: 7779 - DNA, 21 bp, Homo sapiens
cagtcttggccaactcaacat

SEQ ID NO: 7780 - DNA, 21 bp, Homo sapiens
agaaccccctggcagccagtc

SEQ ID NO: 7781 - DNA, 21 bp, Homo sapiens
gaaccccctggcagccagtct

SEQ ID NO: 7782 - DNA, 21 bp, Homo sapiens
ctcatcttcacctccgccact

SEQ ID NO: 7783 - DNA, 21 bp, Homo sapiens
gtggtgggaaatccgggaagc

SEQ ID NO: 7784 - DNA, 21 bp, Homo sapiens
ggtggtgggaaatccgggaag

SEQ ID NO: 7785 - DNA, 21 bp, Homo sapiens
gcccactttgccgcccccgcc

SEQ ID NO: 7786 - DNA, 21 bp, Homo sapiens
agtagcgcagaagctcctctc

SEQ ID NO: 7787 - DNA, 21 bp, Homo sapiens
ccccatgaggcctggcacttt

SEQ ID NO: 7788 - DNA, 21 bp, Homo sapiens
cgcccactttgccgcccccgc

SEQ ID NO: 7789 - DNA, 21 bp, Homo sapiens
tgggggaagccaccctgcaga

SEQ ID NO: 7790 - DNA, 21 bp, Homo sapiens
ggggaagccaccctgcagagg

SEQ ID NO: 7791 - DNA, 21 bp, Homo sapiens
tgttgaggggcgtcttccaat

SEQ ID NO: 7792 - DNA, 21 bp, Homo sapiens
gggggaagccaccctgcagag

SEQ ID NO: 7793 - DNA, 21 bp, Homo sapiens
agctgcagtgcctccagctcc

SEQ ID NO: 7794 - DNA, 21 bp, Homo sapiens
gttgaggggcgtcttccaatc

SEQ ID NO: 7795 - DNA, 21 bp, Homo sapiens
actcacccagctcttgggggt

SEQ ID NO: 7796 - DNA, 21 bp, Homo sapiens
ctcacccagctcttgggggtg

SEQ ID NO: 7797 - DNA, 21 bp, Homo sapiens
agggaagccagggcccccaaa

SEQ ID NO: 7798 - DNA, 21 bp, Homo sapiens
atggagacactgtgtatggct

SEQ ID NO: 7799 - DNA, 21 bp, Homo sapiens
acaaggagtcccttgaagggt

SEQ ID NO: 7800 - DNA, 21 bp, Homo sapiens
gtatggctaccatattactaa

SEQ ID NO: 7801 - DNA, 21 bp, Homo sapiens
ggcctgccacgccagccgctt

SEQ ID NO: 7802 - DNA, 21 bp, Homo sapiens
ctcaccgttgtaactggacag

SEQ ID NO: 7803 - DNA, 21 bp, Homo sapiens
tgagaaccccagcaaagcgct

SEQ ID NO: 7804 - DNA, 21 bp, Homo sapiens
tgaagctgtcgtctatgttgc

SEQ ID NO: 7805 - DNA, 21 bp, Homo sapiens
atgcaccgccacatcgagctg

SEQ ID NO: 7806 - DNA, 21 bp, Homo sapiens
gtggtggtggtggtggtgggg

SEQ ID NO: 7807 - DNA, 21 bp, Homo sapiens
cgctggccacccacagcgcct

SEQ ID NO: 7808 - DNA, 21 bp, Homo sapiens
tgcagcgcttccggcagtacc

SEQ ID NO: 7809 - DNA, 21 bp, Homo sapiens
gagatccccccctccagcccc

SEQ ID NO: 7810 - DNA, 21 bp, Homo sapiens
gtggatggagtcacctgtgaa

SEQ ID NO: 7811 - DNA, 21 bp, Homo sapiens
ggtaggggaagagggagcctt

SEQ ID NO: 7812 - DNA, 21 bp, Homo sapiens
gtgcacgtaagggcagttgtc

SEQ ID NO: 7813 - DNA, 21 bp, Homo sapiens
tggtgctgcccaaccgtgtga

SEQ ID NO: 7814 - DNA, 21 bp, Homo sapiens
cctggtgctgcccaaccgtgt

SEQ ID NO: 7815 - DNA, 21 bp, Homo sapiens
tctcaccatcacctctccata

SEQ ID NO: 7816 - DNA, 21 bp, Homo sapiens
agaaagattggccagtaccaa

SEQ ID NO: 7817 - DNA, 21 bp, Homo sapiens
cctgcgtcttcgctggcagcc

SEQ ID NO: 7818 - DNA, 21 bp, Homo sapiens
gggccaagatcatggtggttg

SEQ ID NO: 7819 - DNA, 21 bp, Homo sapiens
aaaaaaattggatttcgaaaa

SEQ ID NO: 7820 - DNA, 21 bp, Homo sapiens
ggagggggccgacgccgtgcc

SEQ ID NO: 7821 - DNA, 21 bp, Homo sapiens
cagagctccgctactttgcgg

SEQ ID NO: 7822 - DNA, 21 bp, Homo sapiens
gccagccctgcagggagagga

SEQ ID NO: 7823 - DNA, 21 bp, Homo sapiens
aacagcagcagcagcagcagc

SEQ ID NO: 7824 - DNA, 21 bp, Homo sapiens
agggcgggggccccactggcg

SEQ ID NO: 7825 - DNA, 21 bp, Homo sapiens
agaaagcactcggtggcgccg

SEQ ID NO: 7826 - DNA, 21 bp, Homo sapiens
atgttagtgacaatgaacctg

SEQ ID NO: 7827 - DNA, 21 bp, Homo sapiens
agcccccacagccgccgatgg

SEQ ID NO: 7828 - DNA, 21 bp, Homo sapiens
ttggtatagacgagggcgggg

SEQ ID NO: 7829 - DNA, 20 bp, Homo sapiens
taccaactacaaaaaaaaaa

SEQ ID NO: 7830 - DNA, 21 bp, Homo sapiens
gaaggcgaggaagagatcgac

SEQ ID NO: 7831 - DNA, 21 bp, Homo sapiens
gaactcctggcggatcacctg

SEQ ID NO: 7832 - DNA, 21 bp, Homo sapiens
cttggtcccgcacagctggca

SEQ ID NO: 7833 - DNA, 22 bp, Homo sapiens
ccagtggctcgcaagcctctta

SEQ ID NO: 7834 - DNA, 21 bp, Homo sapiens
tcctgcagtgcggcctgcgcg

SEQ ID NO: 7835 - DNA, 20 bp, Homo sapiens
aattctttccaagccatact

SEQ ID NO: 7836 - DNA, 21 bp, Homo sapiens
cagaaatctacaaaaaaaaaa

SEQ ID NO: 7837 - DNA, 21 bp, Homo sapiens
gccgtacatgctctggagggt

SEQ ID NO: 7838 - DNA, 21 bp, Homo sapiens
cgcgctgggtgtgctgggcaa

SEQ ID NO: 7839 - DNA, 21 bp, Homo sapiens
aggtctctcctcccgccgtga

SEQ ID NO: 7840 - DNA, 21 bp, Homo sapiens
ttcctacctgcgctgtttcct

SEQ ID NO: 7841 - DNA, 22 bp, Homo sapiens
tagcggctcctacaacatcttc

SEQ ID NO: 7842 - DNA, 21 bp, Homo sapiens
actgaaaaatacctgccgaga

SEQ ID NO: 7843 - DNA, 21 bp, Homo sapiens
agctgaggaagctgctccgcg

SEQ ID NO: 7844 - DNA, 21 bp, Homo sapiens
ctaacggcagcccactgtctc

SEQ ID NO: 7845 - DNA, 21 bp, Homo sapiens
ccagtgaagcccctgcaccca

SEQ ID NO: 7846 - DNA, 21 bp, Homo sapiens
ccagtccatgggatctgggca

SEQ ID NO: 7847 - DNA, 21 bp, Homo sapiens
gagcggcaggcgggcgaagcc

SEQ ID NO: 7848 - DNA, 21 bp, Homo sapiens
ctggttctggcacggactgga

SEQ ID NO: 7849 - DNA, 21 bp, Homo sapiens
gttcagtgtggacccctccga

SEQ ID NO: 7850 - DNA, 21 bp, Homo sapiens
gaggcatggaggaagggccgt

SEQ ID NO: 7851 - DNA, 21 bp, Homo sapiens
gctccacggcggcctgcacgg

SEQ ID NO: 7852 - DNA, 21 bp, Homo sapiens
ttgcggcgggcgcagtggaag

SEQ ID NO: 7853 - DNA, 21 bp, Homo sapiens
gtcgcacggcacctcgaggcg

SEQ ID NO: 7854 - DNA, 21 bp, Homo sapiens
acggacctcgggaacctgccc

SEQ ID NO: 7855 - DNA, 23 bp, Homo sapiens
tactggcgggcgaggtggtagga

SEQ ID NO: 7856 - DNA, 21 bp, Homo sapiens
agcctgcaggtcccgccgcag

SEQ ID NO: 7857 - DNA, 21 bp, Homo sapiens
gcagaaatgacggatctgccc

SEQ ID NO: 7858 - DNA, 22 bp, Homo sapiens
aacatggctcgcgaaggactgc

SEQ ID NO: 7859 - DNA, 21 bp, Homo sapiens
agcccctccttctcctccact

SEQ ID NO: 7860 - DNA, 21 bp, Homo sapiens
agaacggctcggcgccttgca

SEQ ID NO: 7861 - DNA, 21 bp, Homo sapiens
tgtgggaaaagtagccactgg

SEQ ID NO: 7862 - DNA, 21 bp, Homo sapiens
ggaggctgagcggctggagca

SEQ ID NO: 7863 - DNA, 21 bp, Homo sapiens
gtcagcacccgcctggccact

SEQ ID NO: 7864 - DNA, 21 bp, Homo sapiens
agccagatccgcgacacggag

SEQ ID NO: 7865 - DNA, 21 bp, Homo sapiens
cgccccctggctgctccttct

SEQ ID NO: 7866 - DNA, 21 bp, Homo sapiens
ctgataaagctgtttctctcc

SEQ ID NO: 7867 - DNA, 21 bp, Homo sapiens
cgggggcggctttgagctgca

SEQ ID NO: 7868 - DNA, 21 bp, Homo sapiens
tcgggggcggctttgagctgc

SEQ ID NO: 7869 - DNA, 21 bp, Homo sapiens
ttggcaatggcggaaaaataa

SEQ ID NO: 7870 - DNA, 21 bp, Homo sapiens
tcatggctggaatgagtttga

SEQ ID NO: 7871 - DNA, 21 bp, Homo sapiens
ccttagtatacataaaataat

SEQ ID NO: 7872 - DNA, 21 bp, Homo sapiens
gccacgaccccgagcctggac

SEQ ID NO: 7873 - DNA, 21 bp, Homo sapiens
ccagcatctagccctgccaca

SEQ ID NO: 7874 - DNA, 21 bp, Homo sapiens
aagtggcaggaaaatgctact

SEQ ID NO: 7875 - DNA, 21 bp, Homo sapiens
tccccgctcctcccccagcca

SEQ ID NO: 7876 - DNA, 21 bp, Homo sapiens
cagcggcgggaggaggtgagg

SEQ ID NO: 7877 - DNA, 21 bp, Homo sapiens
agaaggtaaaggccaagaagg

SEQ ID NO: 7878 - DNA, 21 bp, Homo sapiens
ctgggaagccgcccttcctga

SEQ ID NO: 7879 - DNA, 21 bp, Homo sapiens
tggcggctggtggggcccgtc

SEQ ID NO: 7880 - DNA, 21 bp, Homo sapiens
cctggtggatgaggagttctt

SEQ ID NO: 7881 - DNA, 21 bp, Homo sapiens
gcggtggcccacagcagctgc

SEQ ID NO: 7882 - DNA, 21 bp, Homo sapiens
gtatccaaaggttgctgtgag

SEQ ID NO: 7883 - DNA, 23 bp, Homo sapiens
caacccaaaacatagaagccact

SEQ ID NO: 7884 - DNA, 21 bp, Homo sapiens
gtgaagagccgtggatgaagg

SEQ ID NO: 7885 - DNA, 21 bp, Homo sapiens
cacgaactcagcccgccacag

SEQ ID NO: 7886 - DNA, 21 bp, Homo sapiens
ccgagtgctcgtactgagtct

SEQ ID NO: 7887 - DNA, 22 bp, Homo sapiens
agccacaaaaccaagaagccac

SEQ ID NO: 7888 - DNA, 23 bp, Homo sapiens
ttttaattttttgctattctcct

SEQ ID NO: 7889 - DNA, 21 bp, Homo sapiens
gagcggctggtgcccagggag

SEQ ID NO: 7890 - DNA, 21 bp, Homo sapiens
ccaaaagtgacggggccccag

SEQ ID NO: 7891 - DNA, 21 bp, Homo sapiens
ttcccggagcaggaatacctc

SEQ ID NO: 7892 - DNA, 21 bp, Homo sapiens
gacttaaaacgttcatgaata

SEQ ID NO: 7893 - DNA, 21 bp, Homo sapiens
cgtacttggcgcgaatccacg

SEQ ID NO: 7894 - DNA, 21 bp, Homo sapiens
gcagcccccactggtaagtgt

SEQ ID NO: 7895 - DNA, 21 bp, Homo sapiens
atctccaggattacctggcat

SEQ ID NO: 7896 - DNA, 21 bp, Homo sapiens
ccaacctaattcaaattagaa

SEQ ID NO: 7897 - DNA, 21 bp, Homo sapiens
ctacggctggtctgttggcgg

SEQ ID NO: 7898 - DNA, 21 bp, Homo sapiens
tctcttcctcctctgctcctg

SEQ ID NO: 7899 - DNA, 21 bp, Homo sapiens
ttgtggagtatcctttgaagg

SEQ ID NO: 7900 - DNA, 21 bp, Homo sapiens
aagaaatagagagagtaaaag

SEQ ID NO: 7901 - DNA, 21 bp, Homo sapiens
gcgctccacggctttctggct

SEQ ID NO: 7902 - DNA, 21 bp, Homo sapiens
cgcgctccacggctttctggc

SEQ ID NO: 7903 - DNA, 21 bp, Homo sapiens
agccaatacttttgaagattt

SEQ ID NO: 7904 - DNA, 21 bp, Homo sapiens
gtcggactccgcgtcctgggg

SEQ ID NO: 7905 - DNA, 21 bp, Homo sapiens
tcaccgtctcgcctagcccgg

SEQ ID NO: 7906 - DNA, 21 bp, Homo sapiens
ggttctggacagggcgccgga

SEQ ID NO: 7907 - DNA, 21 bp, Homo sapiens
catggccatggacttgagtgg

SEQ ID NO: 7908 - DNA, 21 bp, Homo sapiens
ccccaatgcctacttcttcgc

SEQ ID NO: 7909 - DNA, 21 bp, Homo sapiens
cccaatgcctacttcttcgct

SEQ ID NO: 7910 - DNA, 21 bp, Homo sapiens
gctcctcgatgtagcgagatg

SEQ ID NO: 7911 - DNA, 21 bp, Homo sapiens
tgctcctcgatgtagcgagat

SEQ ID NO: 7912 - DNA, 21 bp, Homo sapiens
cctcaccctcttttttttctt

SEQ ID NO: 7913 - DNA, 21 bp, Homo sapiens
ctggcatcttagtgccccctg

SEQ ID NO: 7914 - DNA, 21 bp, Homo sapiens
gttggcaggacagcttgaggt

SEQ ID NO: 7915 - DNA, 21 bp, Homo sapiens
gaggccactcagctcctcgca

SEQ ID NO: 7916 - DNA, 21 bp, Homo sapiens
ggaggccactcagctcctcgc

SEQ ID NO: 7917 - DNA, 21 bp, Homo sapiens
agcttcccccgggtcagctgc

SEQ ID NO: 7918 - DNA, 21 bp, Homo sapiens
ggggagctgatgcacacctgc

SEQ ID NO: 7919 - DNA, 21 bp, Homo sapiens
gactcaggtacctcgccgctg

SEQ ID NO: 7920 - DNA, 21 bp, Homo sapiens
agactcaggtacctcgccgct

SEQ ID NO: 7921 - DNA, 21 bp, Homo sapiens
accaatgatgaggtggtcagc

SEQ ID NO: 7922 - DNA, 21 bp, Homo sapiens
gacctgctgggctcagcagtg

SEQ ID NO: 7923 - DNA, 21 bp, Homo sapiens
acctgctgggctcagcagtgg

SEQ ID NO: 7924 - DNA, 21 bp, Homo sapiens
cctgctgggctcagcagtggt

SEQ ID NO: 7925 - DNA, 21 bp, Homo sapiens
cagcctctgcgccgcatgctg

SEQ ID NO: 7926 - DNA, 21 bp, Homo sapiens
caatgccaagctggagatggt

SEQ ID NO: 7927 - DNA, 21 bp, Homo sapiens
aatgccaagctggagatggtg

SEQ ID NO: 7928 - DNA, 21 bp, Homo sapiens
aatgcttccgccgtctccagg

SEQ ID NO: 7929 - DNA, 21 bp, Homo sapiens
gcaggtgaagcgccagcgggg

SEQ ID NO: 7930 - DNA, 21 bp, Homo sapiens
gctcaccgggacattgatctg

SEQ ID NO: 7931 - DNA, 21 bp, Homo sapiens
aggggtaatggctctgctgcg

SEQ ID NO: 7932 - DNA, 21 bp, Homo sapiens
aaggggtaatggctctgctgc

SEQ ID NO: 7933 - DNA, 21 bp, Homo sapiens
gctgctgctgctgctgctgct

SEQ ID NO: 7934 - DNA, 21 bp, Homo sapiens
cggctaagctctgctcctccc

SEQ ID NO: 7935 - DNA, 21 bp, Homo sapiens
ccctgcgcaaccacgtgcggg

SEQ ID NO: 7936 - DNA, 21 bp, Homo sapiens
cctgcataccaatacaggctg

SEQ ID NO: 7937 - DNA, 21 bp, Homo sapiens
ctgcataccaatacaggctgc

SEQ ID NO: 7938 - DNA, 21 bp, Homo sapiens
gcacgcagtcatggtagctct

SEQ ID NO: 7939 - DNA, 21 bp, Homo sapiens
ggctaagctctgctcctccct

SEQ ID NO: 7940 - DNA, 21 bp, Homo sapiens
cagctgcagtgcctccagctc

SEQ ID NO: 7941 - DNA, 21 bp, Homo sapiens
agccaggtcctggcattgtgc

SEQ ID NO: 7942 - DNA, 21 bp, Homo sapiens
aactcgctcccagcacctccg

SEQ ID NO: 7943 - DNA, 21 bp, Homo sapiens
caactcgctcccagcacctcc

SEQ ID NO: 7944 - DNA, 21 bp, Homo sapiens
gcagctgcagtgcctccagct

SEQ ID NO: 7945 - DNA, 21 bp, Homo sapiens
agccccaacctgcaggtgagc

SEQ ID NO: 7946 - DNA, 21 bp, Homo sapiens
ccaggtcctggcattgtgcac

SEQ ID NO: 7947 - DNA, 21 bp, Homo sapiens
gccaggtcctggcattgtgca

SEQ ID NO: 7948 - DNA, 21 bp, Homo sapiens
actcgctcccagcacctccgc

SEQ ID NO: 7949 - DNA, 21 bp, Homo sapiens
caagccaggtcctggcattgt

SEQ ID NO: 7950 - DNA, 21 bp, Homo sapiens
ctcatcaggtggtcctccttg

SEQ ID NO: 7951 - DNA, 21 bp, Homo sapiens
tggtgatatcccttctgtgag

SEQ ID NO: 7952 - DNA, 21 bp, Homo sapiens
aagccaggtcctggcattgtg

SEQ ID NO: 7953 - DNA, 21 bp, Homo sapiens
gggggtgtttgtataatagta

SEQ ID NO: 7954 - DNA, 21 bp, Homo sapiens
ttgaggggcgtcttccaatct

SEQ ID NO: 7955 - DNA, 21 bp, Homo sapiens
tcatcaggtggtcctccttga

SEQ ID NO: 7956 - DNA, 21 bp, Homo sapiens
ccactttatggtttcatctgt

SEQ ID NO: 7957 - DNA, 21 bp, Homo sapiens
actttatggtttcatctgtga

SEQ ID NO: 7958 - DNA, 21 bp, Homo sapiens
gcaccgggaaccagcagagcc

SEQ ID NO: 7959 - DNA, 21 bp, Homo sapiens
tcggtgatccgaccagccacc

SEQ ID NO: 7960 - DNA, 23 bp, Homo sapiens
cacaaggcgcggacctgccgctg

SEQ ID NO: 7961 - DNA, 21 bp, Homo sapiens
agcaaaatagtgaaaaggaga

SEQ ID NO: 7962 - DNA, 21 bp, Homo sapiens
tgatggctcgtcttttgctcg

SEQ ID NO: 7963 - DNA, 21 bp, Homo sapiens
gcagttccggctgcgcgatga

SEQ ID NO: 7964 - DNA, 21 bp, Homo sapiens
gctggccacccacagcgccta

SEQ ID NO: 7965 - DNA, 21 bp, Homo sapiens
cctccaaatacgaaaaagctg

SEQ ID NO: 7966 - DNA, 21 bp, Homo sapiens
gctgcagcgcttccggcagta

SEQ ID NO: 7967 - DNA, 21 bp, Homo sapiens
cgctacacgcccctgaaggag

SEQ ID NO: 7968 - DNA, 21 bp, Homo sapiens
gcgctacacgcccctgaagga

SEQ ID NO: 7969 - DNA, 21 bp, Homo sapiens
cgagatgttggactttttcct

SEQ ID NO: 7970 - DNA, 21 bp, Homo sapiens
gcgagatgttggactttttcc

SEQ ID NO: 7971 - DNA, 21 bp, Homo sapiens
gccaggactcttgtcaagaga

SEQ ID NO: 7972 - DNA, 21 bp, Homo sapiens
gagatgttggactttttcctc

SEQ ID NO: 7973 - DNA, 21 bp, Homo sapiens
aggcagcactgctaggcggtc

SEQ ID NO: 7974 - DNA, 21 bp, Homo sapiens
cccccagatatcccagaggca

SEQ ID NO: 7975 - DNA, 21 bp, Homo sapiens
gcacctttctgtaggaggaga

SEQ ID NO: 7976 - DNA, 21 bp, Homo sapiens
aaagcgttggccagcgccttt

SEQ ID NO: 7977 - DNA, 21 bp, Homo sapiens
aagcgttggccagcgcctttt

SEQ ID NO: 7978 - DNA, 21 bp, Homo sapiens
cgctgtctgatagcgaggagg

SEQ ID NO: 7979 - DNA, 21 bp, Homo sapiens
tgcccttcccggggagaccgc

SEQ ID NO: 7980 - DNA, 21 bp, Homo sapiens
cataacagatcaaggaatcga

SEQ ID NO: 7981 - DNA, 21 bp, Homo sapiens
aattaagtacttacttttcat

SEQ ID NO: 7982 - DNA, 21 bp, Homo sapiens
aaatgtgaggagctgaaaaag

SEQ ID NO: 7983 - DNA, 21 bp, Homo sapiens
gtctgcaggtgagctggtgga

SEQ ID NO: 7984 - DNA, 21 bp, Homo sapiens
ttccatcagcttgacccagca

SEQ ID NO: 7985 - DNA, 21 bp, Homo sapiens
aaaaaaaaattggatttcgaa

SEQ ID NO: 7986 - DNA, 21 bp, Homo sapiens
gagggggccgacgccgtgccc

SEQ ID NO: 7987 - DNA, 21 bp, Homo sapiens
acccctcagccagtttcaagc

SEQ ID NO: 7988 - DNA, 21 bp, Homo sapiens
agctccgctactttgcggaca

SEQ ID NO: 7989 - DNA, 21 bp, Homo sapiens
agagctccgctactttgcgga

SEQ ID NO: 7990 - DNA, 21 bp, Homo sapiens
ctacccctcagccagtttcaa

SEQ ID NO: 7991 - DNA, 21 bp, Homo sapiens
agccagccctgcagggagagg

SEQ ID NO: 7992 - DNA, 21 bp, Homo sapiens
actcctgattcggtttcagca

SEQ ID NO: 7993 - DNA, 21 bp, Homo sapiens
aacatagatgccaacatggag

SEQ ID NO: 7994 - DNA, 21 bp, Homo sapiens
aagcactcaacagccaccgtg

SEQ ID NO: 7995 - DNA, 21 bp, Homo sapiens
ggcaggtgtgtgtgctgaggt

SEQ ID NO: 7996 - DNA, 23 bp, Homo sapiens
acaacaccgccggccgccactgc

SEQ ID NO: 7997 - DNA, 21 bp, Homo sapiens
cagctcgccacccgtcaccct

SEQ ID NO: 7998 - DNA, 20 bp, Homo sapiens
gcgtttgtgcttgttgttgt

SEQ ID NO: 7999 - DNA, 21 bp, Homo sapiens
tactgcagcgcggagggcgag

SEQ ID NO: 8000 - DNA, 21 bp, Homo sapiens
ttttttttttagtttggatta

SEQ ID NO: 8001 - DNA, 22 bp, Homo sapiens
atggctcgccagcgtcgtgcat

SEQ ID NO: 8002 - DNA, 21 bp, Homo sapiens
ccaagtgagccgtccaaggag

SEQ ID NO: 8003 - DNA, 21 bp, Homo sapiens
cccacgaccaccgcctccacc

SEQ ID NO: 8004 - DNA, 21 bp, Homo sapiens
ctgagccgcatccctgccact

SEQ ID NO: 8005 - DNA, 23 bp, Homo sapiens
tcatggcaggtgtgtaggagaca

SEQ ID NO: 8006 - DNA, 21 bp, Homo sapiens
ttcagcaggcgcagggtcacg

SEQ ID NO: 8007 - DNA, 21 bp, Homo sapiens
cgcgcggtacacccccacgtc

SEQ ID NO: 8008 - DNA, 21 bp, Homo sapiens
tggctgggggctgccaagagc

SEQ ID NO: 8009 - DNA, 21 bp, Homo sapiens
gccatggggaacagccactgt

SEQ ID NO: 8010 - DNA, 21 bp, Homo sapiens
acttgcagaaacctgccgata

SEQ ID NO: 8011 - DNA, 21 bp, Homo sapiens
tagaggcaggccggggccaag

SEQ ID NO: 8012 - DNA, 21 bp, Homo sapiens
acccaggaaaatgcaaagctg

SEQ ID NO: 8013 - DNA, 21 bp, Homo sapiens
ggaacctaggcggtgcctggc

SEQ ID NO: 8014 - DNA, 21 bp, Homo sapiens
agggccccctttagggccggg

SEQ ID NO: 8015 - DNA, 20 bp, Homo sapiens
gagttgcggcgggcgcagtg

SEQ ID NO: 8016 - DNA, 21 bp, Homo sapiens
agcagcacggaccagccactc

SEQ ID NO: 8017 - DNA, 21 bp, Homo sapiens
ttagaggagcacttaaaagct

SEQ ID NO: 8018 - DNA, 21 bp, Homo sapiens
cgtcacctgacgaaccacgcg

SEQ ID NO: 8019 - DNA, 21 bp, Homo sapiens
tcatcggcttggttgcccgtt

SEQ ID NO: 8020 - DNA, 21 bp, Homo sapiens
ggctgcagccaccgccgcggc

SEQ ID NO: 8021 - DNA, 21 bp, Homo sapiens
aaaagattttcgagcctctct

SEQ ID NO: 8022 - DNA, 22 bp, Homo sapiens
tcagttgctcagcccgccgttc

SEQ ID NO: 8023 - DNA, 21 bp, Homo sapiens
agagccgtggatgaagggcca

SEQ ID NO: 8024 - DNA, 21 bp, Homo sapiens
gagcggctggaggatgaggag

SEQ ID NO: 8025 - DNA, 21 bp, Homo sapiens
cagctcatcccgcagcttctc

SEQ ID NO: 8026 - DNA, 21 bp, Homo sapiens
tagtggctggtgatggtctcc

SEQ ID NO: 8027 - DNA, 21 bp, Homo sapiens
gctcaccaggcgagccacttt

SEQ ID NO: 8028 - DNA, 21 bp, Homo sapiens
aaccacagggctcaccaggcg

SEQ ID NO: 8029 - DNA, 21 bp, Homo sapiens
agggctcaccaggcgagccac

SEQ ID NO: 8030 - DNA, 21 bp, Homo sapiens
gagaggctggcgctctatcag

SEQ ID NO: 8031 - DNA, 22 bp, Homo sapiens
aggtaaagacttggttccagaa

SEQ ID NO: 8032 - DNA, 21 bp, Homo sapiens
ggctgctgcagccgccactgc

SEQ ID NO: 8033 - DNA, 21 bp, Homo sapiens
aggcggtgagcgagccgcacc

SEQ ID NO: 8034 - DNA, 21 bp, Homo sapiens
gctgtggcggctgcagcctcc

SEQ ID NO: 8035 - DNA, 21 bp, Homo sapiens
gactgtgcagagagtctgcag

SEQ ID NO: 8036 - DNA, 21 bp, Homo sapiens
gacgggcccgagccgcatact

SEQ ID NO: 8037 - DNA, 21 bp, Homo sapiens
cccgtgccagctgccgcagat

SEQ ID NO: 8038 - DNA, 23 bp, Homo sapiens
ccaggccccgccgccagccactc

SEQ ID NO: 8039 - DNA, 21 bp, Homo sapiens
ttgcggcgggcgcagtggaag

SEQ ID NO: 8040 - DNA, 21 bp, Homo sapiens
tcccaacggggcccgccgcgc

SEQ ID NO: 8041 - DNA, 21 bp, Homo sapiens
aggctaggtctcccgccactt

SEQ ID NO: 8042 - DNA, 21 bp, Homo sapiens
ttgcaaggggctcaggagcgg

SEQ ID NO: 8043 - DNA, 21 bp, Homo sapiens
gcagggcctgtcccgctgccc

SEQ ID NO: 8044 - DNA, 21 bp, Homo sapiens
tggcagggcctgtcccgctgc

SEQ ID NO: 8045 - DNA, 21 bp, Homo sapiens
gtccctatggaccagccacac

SEQ ID NO: 8046 - DNA, 21 bp, Homo sapiens
tcgcatctgagcctgccgatg

SEQ ID NO: 8047 - DNA, 21 bp, Homo sapiens
gtggctggggcctgtggccgt

SEQ ID NO: 8048 - DNA, 21 bp, Homo sapiens
tgaaatcactgagcaggagaa

SEQ ID NO: 8049 - DNA, 21 bp, Homo sapiens
agcctaggaggctcccctgcc

SEQ ID NO: 8050 - DNA, 21 bp, Homo sapiens
ccccccttgtgcgccagccgc

SEQ ID NO: 8051 - DNA, 21 bp, Homo sapiens
gccaaggccgccgccagagac

SEQ ID NO: 8052 - DNA, 20 bp, Homo sapiens
aattagacttaaaaaaaaaa

SEQ ID NO: 8053 - DNA, 21 bp, Homo sapiens
tgccacgtagggtcgtctctt

SEQ ID NO: 8054 - DNA, 21 bp, Homo sapiens
acctcttttccgagcccacct

SEQ ID NO: 8055 - DNA, 21 bp, Homo sapiens
cgcaagcgcatgcacgacctc

SEQ ID NO: 8056 - DNA, 21 bp, Homo sapiens
gggcgtggtgatgccgtggtt

SEQ ID NO: 8057 - DNA, 21 bp, Homo sapiens
atggcaggagaaacagccctg

SEQ ID NO: 8058 - DNA, 21 bp, Homo sapiens
aggacgccacgaaagatgcca

SEQ ID NO: 8059 - DNA, 21 bp, Homo sapiens
gtggcatcggcgctgaagtcc

SEQ ID NO: 8060 - DNA, 21 bp, Homo sapiens
agggcgggggccccactggcg

SEQ ID NO: 8061 - DNA, 21 bp, Homo sapiens
agtggcagggctggcgcctgg

SEQ ID NO: 8062 - DNA, 21 bp, Homo sapiens
agggcctagtcatggctgagg

SEQ ID NO: 8063 - DNA, 21 bp, Homo sapiens
acattttttcttagatcgata

SEQ ID NO: 8064 - DNA, 21 bp, Homo sapiens
tcggggtgtccgagggccccg

SEQ ID NO: 8065 - DNA, 21 bp, Homo sapiens
ctggtgctctggccaccgctg

SEQ ID NO: 8066 - DNA, 23 bp, Homo sapiens
gaagtggcagctcccacaaaagg

SEQ ID NO: 8067 - DNA, 21 bp, Homo sapiens
catggccacgtcccctgccac

SEQ ID NO: 8068 - DNA, 21 bp, Homo sapiens
tgggccgctccgaggccagcg

SEQ ID NO: 8069 - DNA, 23 bp, Homo sapiens
tctgaggaccggaggagccgcca

SEQ ID NO: 8070 - DNA, 21 bp, Homo sapiens
taaggaccgcaggcagcctct

SEQ ID NO: 8071 - DNA, 21 bp, Homo sapiens
agagccctcccgtgtgcctga

SEQ ID NO: 8072 - DNA, 22 bp, Homo sapiens
tgctgggcgcggcctgcgccga

SEQ ID NO: 8073 - DNA, 21 bp, Homo sapiens
ttgcggcgggcgcagtggaag

SEQ ID NO: 8074 - DNA, 22 bp, Homo sapiens
ggagtggctgcggtggggaacc

SEQ ID NO: 8075 - DNA, 21 bp, Homo sapiens
tggctgggggctgccaagagc

SEQ ID NO: 8076 - DNA, 20 bp, Homo sapiens
cggtgcggcaggggcccctg

SEQ ID NO: 8077 - DNA, 21 bp, Homo sapiens
gtggctggagtggccccttcg

SEQ ID NO: 8078 - DNA, 21 bp, Homo sapiens
acaccttgcgcgacataggaa

SEQ ID NO: 8079 - DNA, 21 bp, Homo sapiens
ctgccgccgccgtcggggctg

SEQ ID NO: 8080 - DNA, 22 bp, Homo sapiens
gctgggcaggcttgagtccaca

SEQ ID NO: 8081 - DNA, 21 bp, Homo sapiens
atttcccctgttgtgtttttt

SEQ ID NO: 8082 - DNA, 21 bp, Homo sapiens
ttgcctgcactccccgccgtt

SEQ ID NO: 8083 - DNA, 21 bp, Homo sapiens
gtgcagcgcagcagccagtgg

SEQ ID NO: 8084 - DNA, 21 bp, Homo sapiens
ctaatggctactcagacccat

SEQ ID NO: 8085 - DNA, 21 bp, Homo sapiens
gccaagggcagctgccacatc

SEQ ID NO: 8086 - DNA, 22 bp, Homo sapiens
agacccttgggcttcaggttca

SEQ ID NO: 8087 - DNA, 21 bp, Homo sapiens
gccaagcaggccatcctcatc

SEQ ID NO: 8088 - DNA, 21 bp, Homo sapiens
attatggttgataatgatagc

SEQ ID NO: 8089 - DNA, 21 bp, Homo sapiens
tagtggctggtgatggtctcc

SEQ ID NO: 8090 - DNA, 22 bp, Homo sapiens
tggctcgccctggctgctgccc

SEQ ID NO: 8091 - DNA, 21 bp, Homo sapiens
ggccaaccaggcccagccgct

SEQ ID NO: 8092 - DNA, 21 bp, Homo sapiens
gtggccaaccaggcccagccg

SEQ ID NO: 8093 - DNA, 21 bp, Homo sapiens
cagcccccacagccgccgatg

SEQ ID NO: 8094 - DNA, 21 bp, Homo sapiens
agcagcacggaccagccactc

SEQ ID NO: 8095 - DNA, 23 bp, Homo sapiens
gaagaggctcgagctgccgcgcc

SEQ ID NO: 8096 - DNA, 22 bp, Homo sapiens
gggacggcgggtccaggccctg

SEQ ID NO: 8097 - DNA, 21 bp, Homo sapiens
gggctcaggcgggggcggcga

SEQ ID NO: 8098 - DNA, 21 bp, Homo sapiens
gcgagccggagccggaacccg

SEQ ID NO: 8099 - DNA, 21 bp, Homo sapiens
agccggagccggaacccgaac

SEQ ID NO: 8100 - DNA, 22 bp, Homo sapiens
agcttcagccaaccccgccata

SEQ ID NO: 8101 - DNA, 21 bp, Homo sapiens
acatggctggccgcgtcccta

SEQ ID NO: 8102 - DNA, 21 bp, Homo sapiens
ggaggagcgcggccccttccg

SEQ ID NO: 8103 - DNA, 21 bp, Homo sapiens
taccggctggccgccatcttg

SEQ ID NO: 8104 - DNA, 21 bp, Homo sapiens
ggttcagtcaactggaaagtc

SEQ ID NO: 8105 - DNA, 21 bp, Homo sapiens
cacctctctgggatatttcac

SEQ ID NO: 8106 - DNA, 21 bp, Homo sapiens
gactggagtctccccgccact

SEQ ID NO: 8107 - DNA, 22 bp, Homo sapiens
cttttacactctaagccccaac

SEQ ID NO: 8108 - DNA, 21 bp, Homo sapiens
cctcagcgtcgccacggataa

SEQ ID NO: 8109 - DNA, 21 bp, Homo sapiens
gccatggccttgctctggctg

SEQ ID NO: 8110 - DNA, 21 bp, Homo sapiens
ctcgctggcagctgccatacc

SEQ ID NO: 8111 - DNA, 21 bp, Homo sapiens
cacctcgtaggttgtctgctc

SEQ ID NO: 8112 - DNA, 21 bp, Homo sapiens
tcttcctcctctgctcctggg

SEQ ID NO: 8113 - DNA, 21 bp, Homo sapiens
ctcttcctcctctgctcctgg

SEQ ID NO: 8114 - DNA, 21 bp, Homo sapiens
tctggttggcgtctagaagtt

SEQ ID NO: 8115 - DNA, 21 bp, Homo sapiens
agggcaacctgagccggcaca

SEQ ID NO: 8116 - DNA, 21 bp, Homo sapiens
gagggcttcaagaggccgtcc

SEQ ID NO: 8117 - DNA, 21 bp, Homo sapiens
aagcacattcgataaaggata

SEQ ID NO: 8118 - DNA, 21 bp, Homo sapiens
acagaaagtgccacagtattc

SEQ ID NO: 8119 - DNA, 21 bp, Homo sapiens
aaagcacattcgataaaggat

SEQ ID NO: 8120 - DNA, 21 bp, Homo sapiens
cagaaagtgccacagtattct

SEQ ID NO: 8121 - DNA, 21 bp, Homo sapiens
gcccacgatgcccctgttccc

SEQ ID NO: 8122 - DNA, 21 bp, Homo sapiens
gagccttctgctgcaggacag

SEQ ID NO: 8123 - DNA, 21 bp, Homo sapiens
ccacgatgcccctgttccctc

SEQ ID NO: 8124 - DNA, 21 bp, Homo sapiens
cccacgatgcccctgttccct

SEQ ID NO: 8125 - DNA, 21 bp, Homo sapiens
ctatgagccagtgctgctggc

SEQ ID NO: 8126 - DNA, 21 bp, Homo sapiens
cctatgagccagtgctgctgg

SEQ ID NO: 8127 - DNA, 21 bp, Homo sapiens
acaagcagtgcctcttccagg

SEQ ID NO: 8128 - DNA, 21 bp, Homo sapiens
agagccttctgctgcaggaca

SEQ ID NO: 8129 - DNA, 21 bp, Homo sapiens
aagacaagcagtgcctcttcc

SEQ ID NO: 8130 - DNA, 21 bp, Homo sapiens
tgctgctcctcgatgtagcga

SEQ ID NO: 8131 - DNA, 21 bp, Homo sapiens
ctgctgctcctcgatgtagcg

SEQ ID NO: 8132 - DNA, 21 bp, Homo sapiens
accctcaccctcttttttttc

SEQ ID NO: 8133 - DNA, 21 bp, Homo sapiens
gttaaagacaagcagtgcctc

SEQ ID NO: 8134 - DNA, 21 bp, Homo sapiens
tcgtcagacaccagttcgcag

SEQ ID NO: 8135 - DNA, 21 bp, Homo sapiens
cgtcagacaccagttcgcaga

SEQ ID NO: 8136 - DNA, 21 bp, Homo sapiens
gggttaaagacaagcagtgcc

SEQ ID NO: 8137 - DNA, 21 bp, Homo sapiens
tgggttaaagacaagcagtgc

SEQ ID NO: 8138 - DNA, 21 bp, Homo sapiens
ccctcaccctcttttttttct

SEQ ID NO: 8139 - DNA, 21 bp, Homo sapiens
gaagatggggagatgttcatg

SEQ ID NO: 8140 - DNA, 21 bp, Homo sapiens
ccgggggtcctggaggggcgt

SEQ ID NO: 8141 - DNA, 21 bp, Homo sapiens
gggccgggggtcctggagggg

SEQ ID NO: 8142 - DNA, 21 bp, Homo sapiens
gggggtcctggaggggcgtct

SEQ ID NO: 8143 - DNA, 21 bp, Homo sapiens
ggccgggggtcctggaggggc

SEQ ID NO: 8144 - DNA, 21 bp, Homo sapiens
cgggggtcctggaggggcgtc

SEQ ID NO: 8145 - DNA, 21 bp, Homo sapiens
ggggccgggggtcctggaggg

SEQ ID NO: 8146 - DNA, 21 bp, Homo sapiens
gatgcactgtcgaggccccag

SEQ ID NO: 8147 - DNA, 21 bp, Homo sapiens
gggccaggcgaccttgccggc

SEQ ID NO: 8148 - DNA, 21 bp, Homo sapiens
aggaggagctgcagccagaag

SEQ ID NO: 8149 - DNA, 21 bp, Homo sapiens
gaggagctgcagccagaagta

SEQ ID NO: 8150 - DNA, 21 bp, Homo sapiens
aggagctgcagccagaagtag

SEQ ID NO: 8151 - DNA, 21 bp, Homo sapiens
ggttggcaggacagcttgagg

SEQ ID NO: 8152 - DNA, 21 bp, Homo sapiens
acttacctggggcggagagga

SEQ ID NO: 8153 - DNA, 21 bp, Homo sapiens
cttacctggggcggagaggag

SEQ ID NO: 8154 - DNA, 21 bp, Homo sapiens
ttacctggggcggagaggagt

SEQ ID NO: 8155 - DNA, 21 bp, Homo sapiens
tggcgtgtcgccagccccctc

SEQ ID NO: 8156 - DNA, 21 bp, Homo sapiens
gggggagctgatgcacacctg

SEQ ID NO: 8157 - DNA, 21 bp, Homo sapiens
ccgggggagctgatgcacacc

SEQ ID NO: 8158 - DNA, 21 bp, Homo sapiens
cgtgtcgccagccccctctga

SEQ ID NO: 8159 - DNA, 21 bp, Homo sapiens
atcggagtgttcgtggtgtgc

SEQ ID NO: 8160 - DNA, 21 bp, Homo sapiens
ttacctggggagaagccctct

SEQ ID NO: 8161 - DNA, 21 bp, Homo sapiens
gaagacggggtctggggcaga

SEQ ID NO: 8162 - DNA, 21 bp, Homo sapiens
aacgacctgctgggctcagca

SEQ ID NO: 8163 - DNA, 21 bp, Homo sapiens
ctacgtgcagggctccacggg

SEQ ID NO: 8164 - DNA, 21 bp, Homo sapiens
tactgcgtgtccaggctccaa

SEQ ID NO: 8165 - DNA, 21 bp, Homo sapiens
aagacggggtctggggcagaa

SEQ ID NO: 8166 - DNA, 21 bp, Homo sapiens
gcctcatcgtccgtggtggag

SEQ ID NO: 8167 - DNA, 21 bp, Homo sapiens
cctcatcgtccgtggtggagc

SEQ ID NO: 8168 - DNA, 21 bp, Homo sapiens
aagtctacctcgacaggctct

SEQ ID NO: 8169 - DNA, 21 bp, Homo sapiens
ttgcggctggtgccaaaagac

SEQ ID NO: 8170 - DNA, 21 bp, Homo sapiens
tgcatgttggcgatggcaagc

SEQ ID NO: 8171 - DNA, 21 bp, Homo sapiens
caggctcaccgggacattgat

SEQ ID NO: 8172 - DNA, 21 bp, Homo sapiens
gtgggaaatccgggaagccct

SEQ ID NO: 8173 - DNA, 21 bp, Homo sapiens
gccaactcaacattgggctcc

SEQ ID NO: 8174 - DNA, 21 bp, Homo sapiens
gcctgcataccaatacaggct

SEQ ID NO: 8175 - DNA, 21 bp, Homo sapiens
ggtgggaaatccgggaagccc

SEQ ID NO: 8176 - DNA, 21 bp, Homo sapiens
ccaactcgctcccagcacctc

SEQ ID NO: 8177 - DNA, 21 bp, Homo sapiens
cacaggtgaaacgtggccatt

SEQ ID NO: 8178 - DNA, 21 bp, Homo sapiens
tgcagctgcagtgcctccagc

SEQ ID NO: 8179 - DNA, 21 bp, Homo sapiens
agggggtgtttgtataatagt

SEQ ID NO: 8180 - DNA, 21 bp, Homo sapiens
ccccaacctgcaggtgagctc

SEQ ID NO: 8181 - DNA, 21 bp, Homo sapiens
gccccaacctgcaggtgagct

SEQ ID NO: 8182 - DNA, 21 bp, Homo sapiens
ctgcagctgcagtgcctccag

SEQ ID NO: 8183 - DNA, 21 bp, Homo sapiens
caggtgaaacgtggccattag

SEQ ID NO: 8184 - DNA, 21 bp, Homo sapiens
catcaggtggtcctccttgag

SEQ ID NO: 8185 - DNA, 21 bp, Homo sapiens
tgaggggcgtcttccaatctc

SEQ ID NO: 8186 - DNA, 21 bp, Homo sapiens
atcaggtggtcctccttgagc

SEQ ID NO: 8187 - DNA, 21 bp, Homo sapiens
gaggggcgtcttccaatctcg

SEQ ID NO: 8188 - DNA, 21 bp, Homo sapiens
atcactcacccagctcttggg

SEQ ID NO: 8189 - DNA, 21 bp, Homo sapiens
gtgagaaatcattccttcaaa

SEQ ID NO: 8190 - DNA, 21 bp, Homo sapiens
catcactcacccagctcttgg

SEQ ID NO: 8191 - DNA, 21 bp, Homo sapiens
tcactcacccagctcttgggg

SEQ ID NO: 8192 - DNA, 21 bp, Homo sapiens
gatgctgagtaccctgaatgg

SEQ ID NO: 8193 - DNA, 21 bp, Homo sapiens
accaagtgttgctgcaggagc

SEQ ID NO: 8194 - DNA, 21 bp, Homo sapiens
ccaagtgttgctgcaggagct

SEQ ID NO: 8195 - DNA, 21 bp, Homo sapiens
gttcaccctggtgagctgagc

SEQ ID NO: 8196 - DNA, 21 bp, Homo sapiens
tcatggtcattttttcttgtt

SEQ ID NO: 8197 - DNA, 21 bp, Homo sapiens
atcactgtgagaagtttttaa

SEQ ID NO: 8198 - DNA, 21 bp, Homo sapiens
gatcactgtgagaagttttta

SEQ ID NO: 8199 - DNA, 21 bp, Homo sapiens
tggtggccctcaccctgttct

SEQ ID NO: 8200 - DNA, 21 bp, Homo sapiens
gaggggcctgcctgtccccct

SEQ ID NO: 8201 - DNA, 21 bp, Homo sapiens
cgtccagcacgatggggggca

SEQ ID NO: 8202 - DNA, 21 bp, Homo sapiens
gcaggaatcgtgggacgagcc

SEQ ID NO: 8203 - DNA, 21 bp, Homo sapiens
agcatgtcctcaatgacggtg

SEQ ID NO: 8204 - DNA, 21 bp, Homo sapiens
ctgcaaaccacaggctgacca

SEQ ID NO: 8205 - DNA, 21 bp, Homo sapiens
tccatggagcccaacgagatg

SEQ ID NO: 8206 - DNA, 21 bp, Homo sapiens
gtacatgaagaggatgaggaa

SEQ ID NO: 8207 - DNA, 21 bp, Homo sapiens
tggcagttccggctgcgcgat

SEQ ID NO: 8208 - DNA, 21 bp, Homo sapiens
ggcagttccggctgcgcgatg

SEQ ID NO: 8209 - DNA, 21 bp, Homo sapiens
cggctgagccgcaggatggcg

SEQ ID NO: 8210 - DNA, 21 bp, Homo sapiens
cacagacgtgaccgagtatcc

SEQ ID NO: 8211 - DNA, 21 bp, Homo sapiens
ctggccacccacagcgcctat

SEQ ID NO: 8212 - DNA, 21 bp, Homo sapiens
tagggggcggcgctgatgcag

SEQ ID NO: 8213 - DNA, 21 bp, Homo sapiens
cagcgctacacgcccctgaag

SEQ ID NO: 8214 - DNA, 21 bp, Homo sapiens
ctacacgcccctgaaggaggt

SEQ ID NO: 8215 - DNA, 21 bp, Homo sapiens
gctacacgcccctgaaggagg

SEQ ID NO: 8216 - DNA, 21 bp, Homo sapiens
accgcctcaagttcaaggagt

SEQ ID NO: 8217 - DNA, 21 bp, Homo sapiens
ccgggcgcgtgtctgtagact

SEQ ID NO: 8218 - DNA, 21 bp, Homo sapiens
ccgcctcaagttcaaggagtt

SEQ ID NO: 8219 - DNA, 21 bp, Homo sapiens
atgttggccagcttcgaggtc

SEQ ID NO: 8220 - DNA, 21 bp, Homo sapiens
ggaggcctccagggtgagtgt

SEQ ID NO: 8221 - DNA, 21 bp, Homo sapiens
tggaggcctccagggtgagtg

SEQ ID NO: 8222 - DNA, 21 bp, Homo sapiens
catgttggccagcttcgaggt

SEQ ID NO: 8223 - DNA, 21 bp, Homo sapiens
cacctggtgctgcccaaccgt

SEQ ID NO: 8224 - DNA, 21 bp, Homo sapiens
ggcacctttctgtaggaggag

SEQ ID NO: 8225 - DNA, 21 bp, Homo sapiens
gtcctgccgcagccaggcgtg

SEQ ID NO: 8226 - DNA, 21 bp, Homo sapiens
tggagaccctctcccagatgg

SEQ ID NO: 8227 - DNA, 21 bp, Homo sapiens
ttagcgcgcactcaccgcccc

SEQ ID NO: 8228 - DNA, 21 bp, Homo sapiens
gctcctccacgctgccaatca

SEQ ID NO: 8229 - DNA, 21 bp, Homo sapiens
gctgctcctccacgctgccaa

SEQ ID NO: 8230 - DNA, 21 bp, Homo sapiens
ctgctcctccacgctgccaat

SEQ ID NO: 8231 - DNA, 21 bp, Homo sapiens
cggtacgcgacaagtgagtgc

SEQ ID NO: 8232 - DNA, 21 bp, Homo sapiens
ttcctttagccaggacaatag

SEQ ID NO: 8233 - DNA, 21 bp, Homo sapiens
gtacaaacccagacatcctct

SEQ ID NO: 8234 - DNA, 21 bp, Homo sapiens
atgtgaggagctgaaaaagaa

SEQ ID NO: 8235 - DNA, 21 bp, Homo sapiens
ctttcgcgggccaagccgacg

SEQ ID NO: 8236 - DNA, 21 bp, Homo sapiens
cctttcgcgggccaagccgac

SEQ ID NO: 8237 - DNA, 21 bp, Homo sapiens
agggggccgacgccgtgcccc

SEQ ID NO: 8238 - DNA, 21 bp, Homo sapiens
atgccatgggtgggaatctga

SEQ ID NO: 8239 - DNA, 21 bp, Homo sapiens
gctccgctactttgcggacac

SEQ ID NO: 8240 - DNA, 22 bp, Homo sapiens
tgacagagctccgctactttgc

SEQ ID NO: 8241 - DNA, 21 bp, Homo sapiens
agagccagccctgcagggaga

SEQ ID NO: 8242 - DNA, 21 bp, Homo sapiens
ggcagcagcacgaggtgaggg

SEQ ID NO: 8243 - DNA, 21 bp, Homo sapiens
gcttggattacaaggagcctg

SEQ ID NO: 8244 - DNA, 21 bp, Homo sapiens
ctgcttggattacaaggagcc

SEQ ID NO: 8245 - DNA, 21 bp, Homo sapiens
tgcttggattacaaggagcct

SEQ ID NO: 8246 - DNA, 21 bp, Homo sapiens
cttggattacaaggagcctgg

SEQ ID NO: 8247 - DNA, 21 bp, Homo sapiens
cgactgcttggattacaagga

SEQ ID NO: 8248 - DNA, 21 bp, Homo sapiens
ttggattacaaggagcctggc

SEQ ID NO: 8249 - DNA, 21 bp, Homo sapiens
aagccgaacagggccacaagg

SEQ ID NO: 8250 - DNA, 21 bp, Homo sapiens
gcaagccgaacagggccacaa

SEQ ID NO: 8251 - DNA, 21 bp, Homo sapiens
cctttggtcagttctctgagt

SEQ ID NO: 8252 - DNA, 21 bp, Homo sapiens
aacagcaacagcagcagcagc

SEQ ID NO: 8253 - DNA, 21 bp, Homo sapiens
ctagggcacagtcgtagtgcc

SEQ ID NO: 8254 - DNA, 21 bp, Homo sapiens
gcctcaccacctggccacagc

SEQ ID NO: 8255 - DNA, 21 bp, Homo sapiens
ctcaccacctggccacagctg

SEQ ID NO: 8256 - DNA, 21 bp, Homo sapiens
cctcaccacctggccacagct

SEQ ID NO: 8257 - DNA, 21 bp, Homo sapiens
ctacccggagcgggcataccc

SEQ ID NO: 8258 - DNA, 23 bp, Homo sapiens
acaacagcaacagcagcagcagc

SEQ ID NO: 8259 - DNA, 21 bp, Homo sapiens
agaccaccaggaggtggctgg

SEQ ID NO: 8260 - DNA, 21 bp, Homo sapiens
ggcccttcgccgcagcagctc

SEQ ID NO: 8261 - DNA, 21 bp, Homo sapiens
caccactgctgccgccactgc

SEQ ID NO: 8262 - DNA, 21 bp, Homo sapiens
tgaggacctgcggagctggga

SEQ ID NO: 8263 - DNA, 21 bp, Homo sapiens
ccagtggctcgcaagcctctt

SEQ ID NO: 8264 - DNA, 21 bp, Homo sapiens
gtatggcgggagctgctggcc

SEQ ID NO: 8265 - DNA, 21 bp, Homo sapiens
caggcctcgacgttgttggca

SEQ ID NO: 8266 - DNA, 21 bp, Homo sapiens
gttattcacaatatcatcatc

SEQ ID NO: 8267 - DNA, 23 bp, Homo sapiens
caacccaaaacatagaagccact

SEQ ID NO: 8268 - DNA, 21 bp, Homo sapiens
ggactggcagcgcaagcagtt

SEQ ID NO: 8269 - DNA, 21 bp, Homo sapiens
caccgcgcggtacacccccac

SEQ ID NO: 8270 - DNA, 21 bp, Homo sapiens
gtacaagaccggagatgtgcc

SEQ ID NO: 8271 - DNA, 22 bp, Homo sapiens
caggccccgtcctcggcgctgc

SEQ ID NO: 8272 - DNA, 21 bp, Homo sapiens
gccccgtcctcggcgctgcag

SEQ ID NO: 8273 - DNA, 21 bp, Homo sapiens
gactggcaggtccctgaaggc

SEQ ID NO: 8274 - DNA, 21 bp, Homo sapiens
acctccagtgggaccagcaca

SEQ ID NO: 8275 - DNA, 21 bp, Homo sapiens
ggtccagcacgacctccagtg

SEQ ID NO: 8276 - DNA, 3051 bp, Artificial Sequence
  Description of Artificial Sequence: Synthetic polynucleotide
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcaggatgctttcattggatttggaggaaatgtgatcaggcaacaagtcaaggataacgccaaatggtatatcactgattttgtagagctgctgggagaactggaagaa

SEQ ID NO: 8277 - DNA, 1584 bp, Artificial Sequence
  Description of Artificial Sequence: Synthetic polynucleotide
atgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagatcattcataatttcataagacggatccagaccaaaattaaagatcttctgcagcaaatggaagaagggctgaagacagctgatccccatgactgctctgcttatactggctggacaggcatagcccttttgtacctgcagttgtaccgggtcacatgtgaccaaacctacctgctccgatccctggattacgtaaaaagaacacttcggaatctgaatggccgcagggtcaccttcctctgtggggatgctggccccctggctgttggagctgtgatttatcacaaactcagaagtgactgtgagtcccaggaatgtgtcacaaaacttttgcagctccagagatcggttgtctgccaagaatcagaccttcctgatgagctgctttatggacgggcaggttatctgtatgccttactgtacctgaacacagagataggtccaggcaccgtgtgtgagtcagctattaaagaggtagtcaatgctattattgaatcgggtaagactttgtcaagggaagaaagaaaaacggagcgctgcccgctgttgtaccagtggcaccggaagcagtacgttggagcagcccatggcatggctggaatttactatatgttaatgcagccggcagcaaaagtggaccaagaaaccttgacagaaatggtgaaacccagtattgattatgtgcgccacaaaaaattccgatctgggaattacccatcatcattaagcaatgaaacagaccggctggtgcactggtgccacggcgccccgggggtcatccacatgctcatgcaggcgtacaaggggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaa

SEQ ID NO: 8278 - DNA, 3123 bp, Artificial Sequence
  Description of Artificial Sequence: Synthetic polynucleotide
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaa

SEQ ID NO: 8279 - DNA, 2853 bp, Artificial Sequence
  Description of Artificial Sequence: Synthetic polynucleotide
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatc

SEQ ID NO: 8280 - DNA, 1584 bp, Artificial Sequence; identical to SEQ ID NO: 8277
  Description of Artificial Sequence: Synthetic polynucleotide

SEQ ID NO: 8281 - DNA, 3123 bp, Artificial Sequence; identical to SEQ ID NO: 8278
  Description of Artificial Sequence: Synthetic polynucleotide

SEQ ID NO: 8282 - DNA, 3150 bp, Artificial Sequence
  Description of Artificial Sequence: Synthetic polynucleotide
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgactttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatc

SEQ ID NO: 8283 - DNA, 3696 bp, Artificial Sequence
  Description of Artificial Sequence: Synthetic polynucleotide
atggccaggcagccaccgccgccctgggtccatgcagccttcctcctctgcctcctcagtcttggcggagccatcgaaattcctatggatctgacgcagccgccaaccatcaccaagcagtcagcgaaggatcacatcgtggacccccgtgataacatcctgattgagtgtgaagcaaaagggaaccctgcccccagcttccactggacacgaaacagcagattcttcaacatcgccaaggacccccgggtgtccatgaggaggaggtctgggaccctggtgattgacttccgcagtggcgggcggccggaggaatatgagggggaatatcagtgcttcgcccgcaacaaatttggcacggccctgtccaataggatccgcctgcaggtgtctaaatctcctctgtggcccaaggaaaacctagaccctgtcgtggtccaagagggcgctcctttgacgctccagtgcaaccccccgcctggacttccatccccggtcatcttctggatgagcagctccatggagcccatcacccaagacaaacgtgtctctcagggccataacggagacctatacttctccaacgtgatgctgcaggacatgcagaccgactacagttgtaacgcccgcttccacttcacccacaccatccagcagaagaaccctttcaccctcaaggtcctcaccaaccacccttataatgactcgtccttaagaaaccaccctgacatgtacagtgcccgaggagttgcagaaagaacaccaagcttcatgtatccccagggcaccgcgagcagccagatggtgcttcgtggcatggacctcctgctggaatgcatcgcctccggggtcccaacaccagacatcgcatggtacaagaaaggtggggacctcccatctgataaggccaagtttgagaactttaataaggccctgcgtatcacaaatgtctctgaggaagactccggggagtatttctgcctggcctccaacaagatgggcagcatccggcacacgatctcggtgagagtaaaggctgctccctactggctggacgaacccaagaaccttattctggctcctggcgaggatgggagactggtgtgtcgagccaatggaaaccccaaacccactgtccagtggatggtgaatggggaacctttgcaatcggcaccacctaacccaaaccgtgaggtggccggagacaccatcatcttccgggacacccagatcagcagcagggctgtgtaccagtgcaacacctccaacgagcatggctacctgctggccaacgcctttgtcagtgtgctggatgtgccgcctcggatgctgtcgccccggaaccagctcattcgagtgattctttacaaccggacgcggctggactgccctttctttgggtctcccatccccacactgcgatggtttaagaatgggcaaggaagcaacctggatggtggcaactaccatgtttatgagaacggcagtctggaaattaagatgatccgcaaagaggaccagggcatctacacctgtgtcgccaccaacatcctgggcaaagctgaaaaccaagtccgcctggaggtcaaagaccccaccaggatctaccggatgcccgaggaccaggtggccagaaggggcaccacggtgcagctggagtgtcgggtgaagcacgacccctccctgaaactcaccgtctcctggctgaaggatgacgagccgctctatattggaaacaggatgaagaaggaagacgactccctgaccatctttggggtggcagagcgggaccagggcagttacacgtgtgtcgccagcaccgagctagaccaagacctggccaaggcctacctcaccgtgctagctgatcaggccactccaactaaccgtttggctgccctgcccaaaggacggccagaccggccccgggacctggagctgaccgacctggccgagaggagcgtgcggctgacctggatccccggggatgctaacaacagccccatcacagactacgtcgtccagtttgaagaagaccagttccaacctggggtctggcatgaccattccaagtaccccggcagcgttaactcagccgtcctccggctgtccccgtatgtcaactaccagttccgtgtcattgccatcaacgaggttgggagcagccaccccagcctcccatccgagcgctaccgaaccagtggagcaccccccgagtccaatcctggtgacgtgaagggagaggggaccagaaagaacaacatggagatcacgtggacgcccatgaatgccacctcggcctttggccccaacctgcgctacattgtcaagtggaggcggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagattacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggc

SEQ ID NO: 8284 - DNA, 3123 bp, Artificial Sequence; identical to SEQ ID NO: 8278
  Description of Artificial Sequence: Synthetic polynucleotide

SEQ ID NO: 8285 - DNA, 3123 bp, Artificial Sequence; identical to SEQ ID NO: 8278
  Description of Artificial Sequence: Synthetic polynucleotide

SEQ ID NO: 8286 - DNA, 1065 bp, Artificial Sequence
  Description of Artificial Sequence: Synthetic polynucleotide
atgttcaagagaatggccgaatttgggcctgactccggcgggagagtaaagggtgttactatcgttaaaccaatagtttacggtaatgttgctcggtattttggaaagaaaagagaagaagatgggcacactcatcagtggacagtatatgtgaaaccatatagaaatgaggatatgtcagcatatgtgaagaaaatccagtttaaattacatgaaagctatggcaatcctttaagagttgttactaaacctccatatgaaattactgaaacaggatggggtgaattcgaaataatcatcaaaatatttttcattgaccctaatgaaagacctgtaaccctgtatcatttgctaaagctgtttcaatcagacaccaatgcaatgctggggaaaaagacagtggtttcagagttctatgatgaaatgatatttcaagacccaacagcaatgatgcaacaattattgacaacatctcgtcagctaacattaggagcctataagcatgaaacagaatatccatatgtcaaacttctgcttgatgctatgaaacactcaggttgtgctgttaacaaagatagacacttttcttgcgaagactgtaatggaaatgtcagtggaggttttgatgcttcaacatctcagatagttttgtgccagaataatatccataatcaggcccatatgaacagagtggtcacacacgagcttattcatgcatttgatcattgtcgtgcccatgtcgactggttcaccaacatcagacatttggcgtgctcagaggttcgagctgctaaccttagtggagactgctcacttgtcaatgaaatattcaggttacattttggattaaaacaacaccaccagacttgtgtgcgagacagagccactctttctatcctggctgttaggaatatcagcaaagaagtagctaaaaaggctgttgatgaagtttttgaatcttgtttcaatgaccatgaaccttttggaaggatcccacataacaagacttatgcaagatatgctcacagagactttgaaaaccgtgatcggtattattcaaatata

SEQ ID NO: 8287 - DNA, 2958 bp, Artificial Sequence
  Description of Artificial Sequence: Synthetic polynucleotide
atgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagtcctggatcagtgagagtgtggaggccgacgtgcgcctccgcctggccaatgtgtcggagcgggacgggggcgagtacctctgtcgagccaccaatttcataggcgtggccgagaaggccttttggctgagcgttcacgggccccgagcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatc

SEQ ID NO: 8288 - DNA, 1095 bp, Artificial Sequence
  Description of Artificial Sequence: Synthetic polynucleotide
atgcacgggggtggccccccctcgggggacagcgcatgcccgctgcgcaccatcaagagagtccagttcggagtcctgagtccggatgaactggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaaccacctggatgagctgacggcagcccattcgctctgcttctccccggatggctcccagctcttctgtggcttcaaccggactgtgcgtgttttttccacggcccggcctggccgagactgcgaggtccgagccacatttgcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggatgctgagctcctgtgctgggatctccggcagtctggttacccactgtggtccctgggtcgagaggtgaccaccaatcagcgcatctacttcgatctggacccgaccgggcagttcctagtgagtggcagcacgagcggggctgtctctgtgtgggacacggacgggcctggcaatgatgggaagccggagcccgtgttgagttttctgccccagaaggactgcaccaatggcgtgagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggcgccagactccagcatccctgatgatcaccagggcgagaaagggcagggaggaacggagggaggtgtgggtgagctgata

SEQ ID NO: 8289 - DNA, 3123 bp, Artificial Sequence; identical to SEQ ID NO: 8278
  Description of Artificial Sequence: Synthetic polynucleotide

SEQ ID NO: 8290 - DNA, 465 bp, Artificial Sequence
  Description of Artificial Sequence: Synthetic polynucleotide
atggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcagggcgacatagatgctatctttaaggatctcagcataaggagtgtacggctagtcagagacaaagacacagataaatttaaaggattctgctatgtagaattcgatgaagtggattcccttaaggaagccttgacatacgatggtgcactgttgggcgatcggtcacttcgtgtggacattgcagaaggcagaaaacaagataaaggtggctttggattcagaaaaggtggaccagatgacagagaaataaaagagactgatggaagctctcagatcaagcaagaaccagaccccacgtgg

SEQ ID NO: 8291 - DNA, 684 bp, Artificial Sequence
  Description of Artificial Sequence: Synthetic polynucleotide
atgttaaccatgagcgtgacactttcccccctgaggtcacaggacctggatcccatggctactgatgcttcacccatggccatcaacatgacacccactgtggagcagggtgagggagaagaggcaatgaaggacatggactctgaccagcagtatgaaaagccacccccactacacacaggggctgactggaagattgtcctccacttacctgaaattgagacctggctccggatgacctcagagagggtccgagacctaacctattcagtccagcaggattcggacagcaagcatgtggatgtacatctagttcaactaaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagac

SEQ ID NO: 8292 - DNA, 984 bp, Artificial Sequence
  Description of Artificial Sequence: Synthetic polynucleotide
atggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggagattgaccccagcctgggcgtggcggagctgcctgacgagttcttcgaggaggacaacatgctgagcatgggcaagaagatgatgcaggaggccatgagcgcatttcccggcatcgatgaggccatgagctatgccgaggtcatgaggctggtgaagggcatgaacttctcggtggtggtatttgacacggcacccacgggccacaccctgaggctgctcaacttccccaccatcgtggagcggggcctgggccggcttatgcagatcaagaaccagatcagccctttcatctcacagatgtgcaacatgctgggcctgggggacatgaacgcagaccagctggcctccaagctggaggagacgctgcccgtcatccgctcagtcagcgaacagttcaaggaccctgagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccagatggaggacctgtatgaagacttccacatcgtgaagctgccgctgttaccccatgaggtgcggggggcagacaaggtcaacaccttctcggccctcctcctggagccctacaagccccccagtgcccag

SEQ ID NO: 8293 - DNA, 993 bp, Artificial Sequence
  Description of Artificial Sequence: Synthetic polynucleotide
atggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaaggccctgagcctgtgcaattatttcgagagtcaaaatgtggatttccgaggcaagaaggtgatcgaactgggtgcggggacaggcatcgtggggatcttggcagcgctgcaggggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcatgggacagagagcttctttcagcacctcctgccccagcatttccaactggagctggctcagcgggatgaggatgaaaatgtcaacatctatagggccaggcacagggaaccaagacctgct

SEQ ID NO: 8294 - DNA, 3765 bp, Artificial Sequence
  Description of Artificial Sequence: Synthetic polynucleotide
atggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtgactgtgtccccagcccctgccacaatggtgggacatgcttggaggaggaggaaggggtccgctgcctatgtctgcctggctatgggggggacctgtgcgatgttggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacaaccggtaccgggagtaccagtggatcggactcaacgacaggaccatcgaaggcgacttcttgtggtcggatggcgtccccctgctctatgagaactggaaccctgggcagcctgacagctacttcctgtctggagagaactgcgtggtcatggtgtggcatgatcagggacaatggagtgacgtgccctgcaactaccacctgtcctacacctgcaagatggggctggtgtcctgtgggccgccaccggagctgcccctggctcaagtgttcggccgcccacggctgcgctatgaggtggacactgtgcttcgctaccggtgccgggaaggactggcccagcgcaatctgccgctgatccgatgccaagagaacggtcgttgggaggccccccagatctcctgtgtgcccagaagacctgtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggc

SEQ ID NO: 8295 - DNA, 2718 bp, Artificial Sequence
  Description of Artificial Sequence: Synthetic polynucleotide
atggatcaggtaatgcagtttgttgagccaagtcggcagtttgtaaaggactccattcggctggttaaaagatgcactaaacctgatagaaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagca

SEQ ID NO: 8296 - DNA, 891 bp, Artificial Sequence
  Description of Artificial Sequence: Synthetic polynucleotide
atgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagaggaattgttggataaatatttaatagccaatgcaactaatccagagagtaaggtcttctatctgaaaatgaagggtgattacttccggtaccttgctgaagttgcgtgtggtgatgatcgaaaacaaacgatagataattcccaaggagcttaccaagaggcatttgatataagcaagaaagagatgcaacccacacacccaatccgcctggggcttgctcttaacttttctgtattttactatgagattcttaataacccagagcttgcctgcacgctggctaaaacggcttttgatgaggccattgctgaacttgatacactgaatgaagactcatacaaagacagcaccctcatcatgcagttgcttagagacaacctaacactttggacatcagacagtgcaggagaagaatgtgatgcggcagaaggggctgaaaac

SEQ ID NO: 8297 - DNA, 762 bp, Artificial Sequence
  Description of Artificial Sequence: Synthetic polynucleotide
atggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacaggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagatacaggtttgacccccgtctcatgttcagcaatcgcggcagtgtcaggactcgaagattttccaaacatcttctg

SEQ ID NO: 8298 - DNA, 843 bp, Artificial Sequence
  Description of Artificial Sequence: Synthetic polynucleotide
atggcggaccccggcccagatcccgaatctgagtcggaatcggtgttcccgcgggaggtcgggctctttgcagactcttactcggagaagagccagttctgtttctgtgggcatgtgctgaccatcacgcagaactttgggtcccgcctcggggtggcggcgcgcgtgtgggacgcggccctgagcctgtgcaattatttcgagagtcaaaatgtggatttccgaggcaagaaggtgatcgaactgggtgcggggacaggcatcgtggggatcttggcagcgctgcaggtggaactgtcaccgctgttcccagacacacttattctgggtctggagatccgggtgaaggtctcagactatgtacaagaccggattcgggccctacgcgcagctcctgcaggtggcttccagaacatcgcctgtctccgtagcaatgccatgaagcaccttcctaacttcttctacaagggccagctgacaaagatgttcttcctcttccccgacccacatttcaagcggacaaagcacaagtggcgaatcatcagtcccaccctgctagcagaatatgcctacgtgctaagagttggggggctggtgtataccataaccgatgtgctggagctacacgactggatgtgcactcatttcgaagagcacccactgtttgagcgtgtgcctctggaggacctgagtgaagaccccgttgtgggacatctaggcacctcaactgaggaggggaagaaagttctacgtaatggagggaagaatttcccagccatcttccgaagaatacaagatcccgtcctccaggcagtgacctcccaaaccagcctgcctggtcac

SEQ ID NO: 8299 - DNA, 735 bp, Artificial Sequence
  Description of Artificial Sequence: Synthetic polynucleotide
atggtcccggctgccggtcgacgaccgccccgcgtcatgcggctcctcggctggtggcaagtattgctgtgggtgctgggacttcccgtccgcggcgtggagggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgc

SEQ ID NO: 8300 - DNA, 1221 bp, Artificial Sequence
  Description of Artificial Sequence: Synthetic polynucleotide
atggacggtttcgccggcagtctcggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctat

SEQ ID NO: 8301 - DNA, 306 bp, Artificial Sequence
  Description of Artificial Sequence: Synthetic polynucleotide
atgtccgggcagctggagcgttgcgagcgcgaatggcacgagctggagggagaatttcaagaactgcaggacatgaagaatgcaaccctctccctgaattctaatgacagtgagccaaaatattaccctatagcagttctgttgaaaaaccagaatcaggagctgcctgaggatgtaaaccctgccaaaaaggagaattacctctctgaacaggactttgtgtctgtgtttggcatcacaagagggcaatttgcagctctgcctggctggaaacagctccaaatgaagaaagaaaaggggcttttc

SEQ ID NO: 8302 - DNA, 3786 bp, Artificial Sequence
  Description of Artificial Sequence: Synthetic polynucleotide
atgggtggcccacaggacaaggatgaacgcacaatcgcccttgtgaggccgtggccttgggggcaccaggccctggatccagcatatggcctggacacgatgcacccaagcaggcgcagcctccccttccctctgaactgtcagcttgcaagggttggaactgctgattatggaagtccctcggatcagagtgatcagcagctggactgtgccttggacctaatgaggcgcctgcctccccagcaaatcgagaaaaacctcagcgacctgatcgacctggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaacaaacaaccccaactgtgggagggattgacactggcagcctggagccttgtgtctgtgagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccc

SEQ ID NO: 8303 - DNA, 2544 bp, Artificial Sequence
  Description of Artificial Sequence: Synthetic polynucleotide
atgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttggaaaatctacttcctcatcaagcacccctacagagttctgcaggaatggtggaacctgggaaaatggcagatgtatttgtacagaagagtggaaaggactgagatgtacaattgctaatttttgtgaaaatagtacctatatgggttttacttttgccagaatcccagtgggcagatatggaccatccttgcaaacatgtggcaaggatactccaaatgcgggcaatccaatggcagtccggttgtgcagtctctctctatatggagagatagaattacaaaaagtgacaataggaaattgcaatgaaaatctggaaaccctggaaaagcaggtaaaggatgtcacagcaccacttaataacatttcttctgaagtccagattttaacatctgatgccaataaattaactgctgagaacatcactagtgctacgcgagtggttggacagatattcaacacttccagaaatgcttcacctgaggcaaagaaagttgccatagtaacagtgagtcaactcctagatgccagtgaagatgcttttcaaagagttgctgctactgctaatgatgatgcccttacaacgcttattgagcaaatggagacttattccttgtctttgggtaatcaatcagtggtggaacctaacatagcaatacagtcagcaaatttctcttcagaaaatgcggtggggccttcaaatgttcgcttctctgtgcagaaaggagctagcagttctctagtttctagttcaacatttatacatacaaatgtggatggccttaacccagatgcacagactgagcttcaggtcttgcttaatatgacgaaaaattacaccaagacatgcggctttgtagtttatcaaaatgacaagcttttccaatcaaaaacttttacagctaaatcggattttagtcaaaaaattatctcaagcaaaactgatgaaaatgagcaagatcagagtgcttctgttgacatggtctttagtccaaagtacaaccaaaaagaatttcaactctattcctatgcctgtgtctattggaatttgtcagcgaaggactgggacacatatggctgtcaaaaagacaagggcactgatggattcctgcgctgccgctgcaaccatactactaattttgctgtattaatgactttcaaaaaggattatcaatatcccaaatcacttgacatattatccaacgttggatgtgcactgtctgttactggtctggctctcacagttatatttcagattgtcaccaggaaagtcagaaaaacctcagtaacctgggttttggtcaatctgtgcatatcaatgttgattttcaacctcctctttgtgtttggaattgaaaactccaataagaacttgcagacaagtgatggtgacatcaataatattgactttgacaataatgacatacccaggacagacaccattaacatcccgaatcccatgtgcactgcgattgccgccttactgcactattttctgttagtgacatttacctggaacgcactcagcgctgcacagctctattaccttctaataaggaccatgaagcctcttcctcggcatttcattcttttcatctcattaattggatggggagtcccagctatagtagtggctataacagtgggagttatttattctcagaatggaaataatccacagtgggaattagactaccggcaagagaaaatctgctggctggcaattccagaacccaatggtgttataaaaagtccgctgttgtggtcattcatcgtacctgtaaccattatcctcatcagcaatgttgttatgtttattacaatctcgatcaaagtgctgtggaagaataaccagaacctgacaagcacaaaaaaagtttcatccatgaagaagattgttagcacattatctgttgcagttgtttttggaattacctggattctagcatacctgatgctagttaatgatgatagcatcaggatcgtcttcagctacatattctgccttttcaacactacacagggattgcaaatttttatcctgtacactgttagaacaaaagtcttccagagtgaagcttccaaagtgttgatgttgctatcgtctattgggagaaggaagtcattgccttcagtgacgcggccgaggctgcgtgtaaagatgtataatttcctcaggtcattgccaaccttacatgaacgctttaggctactggaaacctctccgagtactgaggaaatcacactctctgaaagtgacaatgcaaaggaaagcatc

SEQ ID NO: 8304 - DNA, 330 bp, Artificial Sequence
  Description of Artificial Sequence: Synthetic polynucleotide
atggcccccgcccgtctgttcgcgctgctgctgttcttcgtaggcggagtcgccgagtcggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataat

SEQ ID NO: 8305 - DNA, 3363 bp, Artificial Sequence
  Description of Artificial Sequence: Synthetic polynucleotide
atgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagagggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagcagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcc

SEQ ID NO: 8306 - DNA, 564 bp, Artificial Sequence
  Description of Artificial Sequence: Synthetic polynucleotide
atgtcagtggacatgaatagccaggggtctgacagcaatgaagaggactatgacccaaattgtgaggaagaggaagaagaagaagaagacgaccctggggacatagaggactattacgtgggagtagccagcgatgtggagcagcagggggctgatgcctttgatcccgaggagtaccagttcacttgcttgacctacaaggaatctgagggtgccctcaatgagcacatgaccagcttagcttctgtcctaaaggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcc

SEQ ID NO: 8307 - DNA, 2778 bp, Artificial Sequence
  Description of Artificial Sequence: Synthetic polynucleotide
atgagccggggcgcgggcgcgcttcagcgccggacaacgacctacctcatctcgctgaccctggttaagctcgagtcggtgcctccgccgccgccttctccgtctgcggccgcggccggcgccgccggtgccagaggctccgagactggggatcctggcagcccccgaggcgcggaggagccgggcaagaagcggcacgaacgtctcttccaccggcaggatgcgctgtggatcagcacgagcagcgcgggcaccgggggcgcggagcccccagccctgtccccggctccggccagtccggcccgcccagtctcccccgctcccggccgccgcctctccctctgggccgtccctccgggacccccgctctccgggggactgagccccgaccccaagcctgggggcgcccccacctcctcccggcgccccctgctcagcagcccgagctggggcggcccggagcccgaaggccgggcgggcggcggcatccctggctcatcctctccgcaccctggcaccggcagccggaggctcaaggtggcgcctcctccgccggctcccaagccttgcaagaccgtgaccacgagtggagccaaagccggcgggggcaagggcgcgggtagccgcctgtcatggcccgaaagcgagggcaagcccagggtcaaggggtcaaagagcagcgccgggactggagcttcggtctctgccgccgccaccgccgccgccgccgggggagggggctctacagcttcgacctctggtggggtcggggctggggctggagcccgagggaagttgtcccctcggaaaggcaagagtaagaccttggacaacagtgacttgcatccgggaccgcctgccggctctcctcctccgctaaccctcccaccaactccgagtccagccactgctgtcaccgctgcttccgcgcagccccccgggcctgcacctccaatcactctggagcctccagctccggggctgaaacggggccgggaggggggccgagcatccactcgtgaccgcaagatgctcaagtttatcagcggcatcttcaccaagagcacaggagggcctcctggctccgggccccttcccggaccccccagcctgtcttctggcagcgggtccagggagctgctgggcgccgagctccgcgcttcccctaaggctgtgatcaatagccaggaatggactttgagccgctccattcctgaactgcgcctgggtgtgctgggcgatgccaggagtgggaagtcatcgctcatccaccgattcctgactggctcataccaggtgctggagaagacagagagtgagcagtacaagaaagaaatgttggtggatggacagacacatctggtgctaatccgagaggaagctggggcacctgatgccaagttctcaggctgggcagatgctgtgatcttcgtcttcagcctggaggatgagaacagtttccaggctgtgagccgtctccatgggcagctgagttcccttcgcggggagggacgaggaggcctggccttggcactggtggggacacaagacaggatcagtgcttcctcccctcgggtggtgggagatgctcgtgccagagctctgtgcgcggacatgaaacgctgcagctactatgagacttgtgcaacctatgggctcaatgtggatcgggtcttccaggaggtggcccagaaggtggtgaccttgcgcaagcagcaacagcttctggctgcctgcaagtccctgcccagctccccaagccactcagctgcatccactccggtagctggccaggctagtaacgggggccacactagcgactactcttcttccctcccgtcctcaccgaatgttggtcaccgggagctccgagccgaggcagctgcagtggctggattgagcaccccagggtccctgcaccgggcagccaagcgcaggaccagcctttttgcgaatcgtcggggtagtgactccgagaaacgaagcttggatagtcggggagagacaacagggagtgggcgagccatccccatcaaacagagcttcctactaaaacgaagtggcaattccttgaacaaagaatggaagaagaaatatgtaaccctgtccagtaatggctttctactctaccaccccagtattaacgattacatccacagtacccacggcaaggagatggacttgctgcgaacaacagtcaaagtcccgggcaagcggcccccgagggccatctctgcctttggcccctcagccagcattaacgggctcgtcaaggacatgagcactgtccagatgggtgaaggcctggaagccactactcccatgccaagccctagccccagccccagttccctgcagccaccaccagatcagacatccaaacacctgctgaagccagaccggaatttggcccgagccctcagcacggactgtaccccatctggagacctgagccccctgagtcgggaaccccctccttctcccatggtgaagaagcagaggaggaaaaaattgacaacaccatccaagactgaaggctcggctgggcaggctgaagatgaaggttattctttcagcagtgtcctgtattatggaaatgaagctactcttcttatttttgatctgctgttcttctgtgttgtggatttggcttgccaaaattttattttagcatccttccttacatatctacaacaagagatttttagatatatccgtaatacagtaggacaaaagaatttggcatccaaaacattggtggatcaaagatttttgatt

SEQ ID NO: 8308 - DNA, 285 bp, Artificial Sequence
  Description of Artificial Sequence: Synthetic polynucleotide
atgacccacttcaacaagggcccttcctatgggctctcggccgaagtcaagaacaaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtt

SEQ ID NO: 8309 - DNA, 195 bp, Artificial Sequence
  Description of Artificial Sequence: Synthetic polynucleotide
atgaggcgccagcctgcgaaggtggcggcgctgctgctcgggctgctcttggagcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatt

SEQ ID NO: 8310 - DNA, 1020 bp, Artificial Sequence
  Description of Artificial Sequence: Synthetic polynucleotide
atgcgaccctccgggacggccggggcagcgctcctggcgctgctggctgcgctctgcccggcgagtcgggctctggaggaaaagaaagctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctt

SEQ ID NO: 8311 - DNA, 1836 bp, Artificial Sequence
  Description of Artificial Sequence: Synthetic polynucleotide
atgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcctggggagtttgtggtggccatcggcagtcccttcgccctacagaacacagtgacaacgggcatcgtcagcactgcccagcgggagggcagggagctgggcctccgggactccgacatggactacatccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatg

SEQ ID NO: 8312 - DNA, 5325 bp, Artificial Sequence
  Description of Artificial Sequence: Synthetic polynucleotide
atgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttgcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatg

SEQ ID NO: 8313 - DNA, 2205 bp, Artificial Sequence
  Description of Artificial Sequence: Synthetic polynucleotide
atgccactcctgggtcagacggtgaggtcggcgtctgcgaggacgcggcggtggagtagaagggcagccggagacaggcccggcgccccttccgaggctagacggccccagcttcgcggggatcatggcattgtggaccgagtgcggggccactggcgaatcgccggctcctgttcaacctgctggtgtccatctgcattgtgttcctcaacaaatggatttatgtgtaccttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgttcctctgtgacgagggtgcaggtatctctggggactacatcgatcgcgtggacgagcccttgtcctgctcttatgtgctgaccattcgcactcctcggctctgcccccaccctctcctccggcccccacccagtgctgcaccgcaggccatcctctgtcacccttccctacagcctgaggagtacatggcctacgttcagaggcaagccgactcaaagcagtatggagataaaatcatagaggagctgcaagatctaggcccccaagtgtggagtgagaccaagtctggggtggcaccccaaaagatggcaggtgcgagcccgaccaaggatgacagtaaggactcagatttctggaagatgcttaatgagccagaggaccaggccccaggaggggaggaggtgccggctgaggagcaggacccaagccctgaggcagcagattcagcttctggtgctcccaatgattttcagaacaacgtgcaggtcaaagtcattcgaagccctgcggatttgattcgattcatagaggagctgaaaggtggaacaaaaaaggggaagccaaatataggccaagagcagcctgtggatgatgctgcagaagtccctcagagggaaccagagaaggaaaggggtgatccagaacggcagagagagatggaagaagaggaggatgaggatgaggatgaggatgaagatgaggatgaacggcagttactgggagaatttgagaaggaactggaagggatcctgcttccgtcagaccgagaccggctccgttcggaggtgaaggctggcatggagcgggaactggaaaacatcatccaggagacagagaaagagctggacccagatgggctgaagaaggagtcagagcgggatcgggcaatgctggctctcacatccactctcaacaaactcatcaaaagactggaggaaaaacagagtccagagctggtgaagaagcacaagaaaaagagggttgtccccaaaaagcctcccccatcaccccaacctacagaggaggatcctgagcacagagtccgggtccgggtcaccaagctccgtctcggaggccctaatcaggatctgactgtcctcgagatgaaacgggaaaacccacagctgaaacaaatcgaggggctggtgaaggagctgctggagagggagggactcacagctgcagggaaaattgagatcaaaattgtccgcccatgggctgaagggactgaagagggtgcacgttggctgactgatgaggacacgagaaacctcaaggagatcttcttcaatatcttggtgccgggagctgaagaggcccagaaggaacgccagcggcagaaagagctggagagcaattaccgccgggtgtggggctctccaggtggggagggcacaggggacctggacgaatttgacttc

SEQ ID NO: 8314 - DNA, 3051 bp, Artificial Sequence
  Description of Artificial Sequence: Synthetic polynucleotide
atggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaac

SEQ ID NO: 8315 - DNA, 480 bp, Artificial Sequence
  Description of Artificial Sequence: Synthetic polynucleotide
atggcggacatcgagcagtactacatgaagccgcccgagatcgttaaggaggctgaggtgccgcaggctgcgctgggcgtcccagcccaggggacaggggacaatggccacacgcctgtggaggaggaggtcgggggcatcccagtaccagcaccggggctcctgcaggtcacggagaggaggcagcctctgagcagcgtctcctctctggaggtccacttcgacctcctggacctcactgagctcaccgacatgtcggaccaggagctggccgaggtctttgctgactcggacgacgagaacctcaacaccgagtccccagcaggtctgcacccgctgccccgggccggctacctgcgctccccttcctggacgaggacaagggctgagcagagccacgagaagcagcccctaggcgaccccgagcggcaggccacagtcctggacacgtttctcactgtggagaggccccaggaggac

SEQ ID NO: 8316 - DNA, 4284 bp, Artificial Sequence
  Description of Artificial Sequence: Synthetic polynucleotide
atggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcagatgcaggccctgacttcctgtgagtgcaccatctgtcctgactgcttccgccagcacttcaccatcgccttgaaggagaagcacatcacagacatggtgtgccctgcctgtggccgccccgacctcaccgatgacacacagttgctcagctacttctctacccttgacatccagcttcgcgagagcctagagccagatgcctatgcgttgttccataagaagctgaccgagggtgtgctgatgcgggaccccaagttcttgtggtgtgcccagtgctcctttggcttcatatatgagcgtgagcagctggaggcaacttgtccccagtgtcaccagaccttctgtgtgcgctgcaagcgccagtgggaggagcagcaccgaggtcggagctgtgaggacttccagaactggaaacgcatgaacgacccagaataccaggcccagggcctagcaatgtatcttcaggaaaacggcattgactgccccaaatgcaagttctcgtacgccctggcccgaggaggctgcatgcactttcactgtacccagtgccgccaccagttctgcagcggctgctacaatgccttttacgccaagaataaatgtccagagcctaactgcagggtgaaaaagtccctgcacggccaccaccctcgagactgcctcttctacctgcgggactggactgctctccggcttcagaagctgctacaggacaataacgtcatgtttaatacagagcctccagctggggcccgggcagtccctggaggcggctgccgagtgatagagcagaaggaggttcccaatgggctcagggacgaagcttgtggcaaggaaactccagctggctatgccggcctgtgccaggcacactacaaagagtatcttgtgagcctcatcaatgcccactcgctggacccagccaccttgtatgaggtggaagagctggagacggccactgagcgctacctgcacgtacgcccccagcctttggctggagaggatccccctgcttaccaggcccgcttgttacagaagctgacagaagaggtacccttgggacagagtatcccccgcaggcggaag

SEQ ID NO: 8317 - DNA, 3051 bp, Artificial Sequence; identical to SEQ ID NO: 8276
  Description of Artificial Sequence: Synthetic polynucleotide

SEQ ID NO: 8318 - DNA, 1506 bp, Artificial Sequence
  Description of Artificial Sequence: Synthetic polynucleotide
atggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaa

SEQ ID NO: 8319 - DNA, 2319 bp, Artificial Sequence
  Description of Artificial Sequence: Synthetic polynucleotide
atgcttctctcgttacctgccttacatcttcagacctccgaacaccatcctttcttccagctgccacacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaatcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggag

SEQ ID NO: 8320 - DNA, 4284 bp, Artificial Sequence; identical to SEQ ID NO: 8316
  Description of Artificial Sequence: Synthetic polynucleotide

SEQ ID NO: 8321 - DNA, 837 bp, Artificial Sequence
  Description of Artificial Sequence: Synthetic polynucleotide
atggctgagctggatccgttcggcgcccctgccggcgcccctggcggtcccgcgctggggaacggagtggccggcgccggcgaagaagacccggctgcggccttcttggcgcagcaagagagcgagattgcgggcatcgagaacgacgaggccttcgccatcctggacggcggcgcccccgggccccagccgcacggcgagccgccggggggtccggatgctgttgatggagtaatgaatggtgaatactaccaggaaagtaatggtccaacagacagttatgcagctatttcacaagtggatcgattgcagtcagagcctgaaagtatccgtaaatggagagaagaacaaatggaacgcttggaagcccttgatgccaattctcggaagcaagaagcagagtggaaagaaaaggcaataaaggagctagaagaatggtatgcaagacaggacgagcagctacagaaaacaaaagcaaacaacaggactatcctattaagtgtaatctcactgcttaatgagcccaacaccttctccccagccaatgtcgatgcttcagttatgttcaggaaatggagagacagtaaaggaaaagacaaagaatatgctgaaattattaggaaacaagtttcagccactaaggccgaagcagaaaaggatggagtgaaggtccccacaaccctggcggaatactgcatcaaaactaaagtgccttccaatgacaacagctcagatttgctttacgacgacttgtatgatgacgacattgatgatgaagatgaggaggaggaagatgccgactgttatgatgatgatgattctgggaatgaggagtcg

SEQ ID NO: 8322 - DNA, 558 bp, Artificial Sequence
  Description of Artificial Sequence: Synthetic polynucleotide
atgtcgcggcctgtcaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacattgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacgcatccatggagtcaacgagaaaatctcagtccaagcctatgagacccaagtgaaattcatctttgagttgattcagaatgctgacacagaccaggagccagtttctcacctgcacaaactg

SEQ ID NO: 8323 - DNA, 2820 bp, Artificial Sequence
  Description of Artificial Sequence: Synthetic polynucleotide
atgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagt

SEQ ID NO: 8324 - DNA, 1188 bp, Artificial Sequence
  Description of Artificial Sequence: Synthetic polynucleotide
atgaagaccccggcggacacaggtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattcttatccctcctcacttgaggtccccagcgggcactaccaccctcaccccgtcctcacaagctttaactgagactccgaccagctcagactggcagtcgaccgatgccacacctaccctcactaactcctcc

SEQ ID NO: 8325 - DNA, 3132 bp, Artificial Sequence
  Description of Artificial Sequence: Synthetic polynucleotide
atgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcaga

SEQ ID NO: 8326 - DNA, 2049 bp, Artificial Sequence
  Description of Artificial Sequence: Synthetic polynucleotide
atggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtca

SEQ ID NO: 8327 - DNA, 6405 bp, Artificial Sequence
  Description of Artificial Sequence: Synthetic polynucleotide
atggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggctcccagccaacctctgataaaccctcccagcggccatcagagagcacaaattgtagccctacccggaaaaggtcttcatctgagagtacttcttcaacagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcacaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaaggagcagcactgcacctcagtcctgacacagttacagatgtaattgaggctgttgttcagagtgtaaatctgaacccagaacataaaaaggggttgaagagaaaaggttggctattggaagaacagaccagaaaaaagcagaagccattaccagaggaagaagagcaagagaataataaaagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagacttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctc

SEQ ID NO: 8328 - DNA, 1533 bp, Artificial Sequence
  Description of Artificial Sequence: Synthetic polynucleotide
atgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccccgagctggcagatccctgcgtgttggccaagactacagaggagaccgaggtggagctgggccaacagggccaatccctactgcagctgccgaggacggccgtcaagtctgtctccacgctcatggtctctgccctgcagagcggctggcagatgtgcagctggaagtcatcagtgagttctgcctcagtcagctcccaagtgaggacgcagtcacctttgaagactccggaggctgagttgctgtgggaggtgtacctggtgctgtgggccgttcggaaacacctgcgccggctgtaccgcaggcaggagaggcacagacggcaccacgtccgatgccatgctgccccccgacccaacccggctcagtccctgaaactggatgcccaaagtcccctc

SEQ ID NO: 8329 - DNA, 1833 bp, Artificial Sequence
  Description of Artificial Sequence: Synthetic polynucleotide
atggctctgcggaggctgggggccgcgctgctgctgctgccgctgctcgccgccgtggaaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagc

SEQ ID NO: 8330 - DNA, 795 bp, Artificial Sequence
  Description of Artificial Sequence: Synthetic polynucleotide
atgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtttggaaacacatgctactg

SEQ ID NO: 8331 - DNA, 3099 bp, Artificial Sequence
  Description of Artificial Sequence: Synthetic polynucleotide
atgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaagggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggcgacctgcaaaagacattcgagattgaactg

SEQ ID NO: 8332 - DNA, 2583 bp, Artificial Sequence
  Description of Artificial Sequence: Synthetic polynucleotide
atggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctccacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaaggcaagagttagagaggcagcgacggctgctggggtctgtacagcaggatctggagaggagcttgcaggatgccagccgcggggacccagctcatgctggcttggctgagctgggccacagattggcccagaaactgcagggcctggagaactggggccaggaccctggggtctctgccaatgcctcaaaggcctggcaccagaagtcccacttccagaattctagggagtggagtggaaaggaaaagtggtgggatgggcagagagaccggaaggctgagcactggaaacataagaaggaagaatctggccgggaaaggaagaagaactggggaggtcaggaggacagggagccagcaggaaggtggaaggagggcaggccaagggtggaggagtcggggagcaagaaggagggcaagcgacagggcccgaaggaacccccaaggaaaagtggtagcttccactcctctggagaaaagcagaagcaacctcggtggagggaagggactaaggacagccatgaccccctgccatcctgggcagagctgttgaggcccaagtaccgggcaccccagggctgctcaggtgtggacgagtgtgcccggcaggagggcctgactttctttggcacagagctagccccagtgcggcaacaggagctggcctctctgctaagaacatacttggcacggctgccctgggctgggcagctgaccaaggagctacccctctcacctgctttctttggtgaggatggcatcttccgtcatgaccgcctccgcttccgggattttgtggatgccctggaggacagcttggaggaggtggctgtgcaacagacaggtgatgatgatgaagtagatgactttgaggacttcatcttcagccacttctttggagacaaagcactgaagaagagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactt

SEQ ID NO: 8333 - DNA, 3108 bp, Artificial Sequence
  Description of Artificial Sequence: Synthetic polynucleotide
atggaagcacgttctatgctggttccaccccaggcatctgtgtgcttcgaggatgtggctatggcattcacacaggaggagtgggaacagctggacctggcccagaggacactgtaccgagaggtgacactggagacctgggagcatattgtctccctggggcttttcctttccaaatctgatgtgatctctcagctggagcaagaagaggacctgtgcagggcagagcaggaggccccccgaggtaagagcaaagaggcggaaattaagagaatcaacaaggaactggccaacatccgctccaagttcaaaggagacaaagccttggatggctacagtaagaaaaaatatgtgtgtaaactgcttttcatcttcctgcttggccatgacattgactttgggcacatggaggctgtgaatctgttgagttccaataaatacacagagaagcaaataggttacctgttcatttctgtgctggtgaactcgaactcggagctgatccgcctcatcaacaacgccatcaagaatgacctggccagccgcaaccccaccttcatgtgcctggccctgcactgcatcgccaacgtgggcagccgggagatgggcgaggcctttgccgctgacatcccccgcatcctggtggccggggacagcatggacagtgtcaagcagagtgcggccctgtgcctccttcgactgtacaaggcctcgcctgacctggtgcccatgggcgagtggacggcgcgtgtggtacacctgctcaatgaccagcacatgggtgtggtcacggccgccgtcagcctcatcacctgtctctgcaagaagaacccagatgacttcaagacgtgcgtctctctggctgtgtcgcgcctgagccggatcgtctcctctgcctccaccgacctccaggactacacctactacttcgtcccagcaccctggctctcggtgaagctcctgcggctgctgcagtgctacccgcctccagaggatgcggctgtgaaggggcggctggtggaatgtctggagactgtgctcaacaaggcccaggagccccccaaatccaagaaggtgcagcattccaacgccaagaacgccatcctcttcgagaccatcagcctcatcatccactatgacagtgagcccaacctcctggttcgggcctgcaaccagctgggccagttcctgcagcaccgggagaccaacctgcgctacctggccctggagagcatgtgcacgctggccagctccgagttctcccatgaagccgtcaagacgcacattgacaccgtcatcaatgccctcaagacggagcgggacgtcagcgtgcggcagcgggcggctgacctcctctacgccatgtgtgaccggagcaatgccaagcagatcgtgtcggagatgctgcggtacctggagacggcagactacgccatccgcgaggagatcgtcctgaaggtggccatcctggccgagaagtacgccgtggactacagctggtacgtggacaccatcctcaacctcatccgcattgcgggcgactacgtgagtgaggaggtgtggtaccgtgtgctacagatcgtcaccaaccgtgatgacgtccagggctatgccgccaagaccgtctttgaggcgctccaggcccctgcctgtcacgagaacatggtgaaggttggcggctacatccttggggagtttgggaacctgattgctggggacccccgctccagccccccagtgcagttctccctgctccactccaagttccatctgtgcagcgtggccacgcgggcgctgctgctgtccacctacatcaagttcatcaacctcttccccgagaccaaggccaccatccagggcgtcctgcgggccggctcccagctgcgcaatgctgacgtggagctgcagcagcgagccgtggagtacctcaccctcagctcagtggccagcaccgacgtcctggccacggtgctggaggagatgccgcccttccccgagcgcgagtcgtccatcctggccaagctgaaacgcaagaaggggccaggggccggcagcgccctggacgatggccggagggaccccagcagcaacgacatcaacgggggcatggagcccacccccagcactgtgtcgacgccctcgccctccgccgacctcctggggctgcgggcagcccctcccccggcagcacccccggcttctgcaggagcagggaaccttctggtggacgtcttcgatggcccggccgcccagcccagcctggggcccacccccgaggaggccttcctcagcgagctggagccgcctgcccccgagagccccatggctttgctggctgacccagctccagctgctgacccaggtcctgaggacatcggccctcccattccggaagccgatgagttgctgaataagtttgtgtgtaagaacaacggggtcctgttcgagaaccagctgctgcagatcggagtcaagtcagagttccgacagaacctgggccgcatgtatctcttctatggcaacaagacctcggtgcagttccagaatttctcacccactgtggttcacccgggagacctccagactcatctggctgtgcagaccaagcgcgtggcggcgcaggtggacggcggcgcgcaggtgcagcaggtgctcaatatcgagtgcctgcgggacttcctgacgcccccgctgctgtccgtgcgcttccggtacggtggcgccccccaggccctcaccctgaagctcccagtgaccatcaacaagttcttccagcccaccgagatggcggcccaggatttcttccagcgctggaagcagctgagcctccctcaacaggaggcgcagaaaatcttcaaagccaaccaccccatggacgcagaagttactaaggccaagcttctggggtttggctctgctctcctggacaatgtggaccccaaccctgagaacttcgtgggggcggggatcatccagactaaagccctgcaggtgggctgtctgcttcggctggagcccaatgcccaggcccagatgtaccggctgaccctgcgcaccagcaaggagcccgtctcccgtcacctgtgtgagctgctggcacagcagttc

SEQ ID NO: 8334 - DNA, 1686 bp, Artificial Sequence
  Description of Artificial Sequence: Synthetic polynucleotide
atggcctcggagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtggctgaggagtgggcccagggcaccttcaaactgaactccaatgatgaggacatccacacagccaatgagcgccgcctgaaggagctcattggtgcaacggcagggaagctgcacacgggacggagccggaatgaccaggtggtcacagacctcaggctgtggatgcggcagacctgctccacgctctcgggcctcctctgggagctcattaggaccatggtggatcgggcagaggcggaacgtgatgttctcttcccggggtacacccatttgcagagggcccagcccatccgctggagccactggattctgagccacgccgtggcactgacccgagactctgagcggctgctggaggtgcggaagcggatcaatgtcctgcccctggggagtggggccattgcaggcaatcccctgggtgtggaccgagagctgctccgagcagaactcaactttggggccatcactctcaacagcatggatgccactagtgagcgggactttgtggccgagttcctgttctgggcttcgctgtgcatgacccatctcagcaggatggccgaggacctcatcctctactgcaccaaggaattcagcttcgtgcagctctcagatgcctacagcacgggaagcagcctgatgccccagaagaaaaaccccgacagtttggagctgatccggagcaaggctgggcgtgtgtttgggcggtgtgccgggctcctgatgaccctcaagggacttcccagcacctacaacaaagacttacaggaggacaaggaagctgtgtttgaagtgtcagacactatgagtgccgtgctccaggtggccactggcgtcatctctacgctgcagattcaccaagagaacatgggacaggctctcagccccgacatgctggccactgaccttgcctattacctggtccgcaaagggatgccattccgccaggcccacgaggcctccgggaaagctgtgttcatggccgagaccaagggggtcgccctcaaccagctgtcactgcaggagctgcagaccatcaggaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctgctgaaccaccggcctgtgactgctgtggagatccagctgatggtggaagagagtgaagagcggctcacggaggagcagattgaagctcttctccacaccgtcaccagcattctgcctgcagagccagaggctgagcagaagaagaatacaaacagcaatgtggcaatggacgaagaggacccagca

SEQ ID NO: 8335 - DNA, 3051 bp, Artificial Sequence; identical to SEQ ID NO: 8276
  Description of Artificial Sequence: Synthetic polynucleotide

SEQ ID NO: 8336 - DNA, 1446 bp, Artificial Sequence
  Description of Artificial Sequence: Synthetic polynucleotide
atgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaagcaaaaagaaaataatattcgttgtttaactacgattggacattttggttttgaatgtttgcccaatcagttggtgagcagatctatccgacaaggattcacttttaatattctctgtgtgggggagactggaattggaaaatcgacactgatagacacattgtttaatactaacttgaaagataacaaatcctcacatttttactcaaatgttggacttcaaattcagacatatgaacttcaggaaagcaatgttcagttgaaattgactgttgtggagacagtagggtatggtgatcaaatagacaaagaagccagctaccaaccaatagttgactacatagatgcccaatttgaggcctatcttcaagaagaactgaagattaaacgttccttgtttgagtaccatgattctcgcgtccacgtgtgtctttacttcatttcacctacaggacattccctgaagtctcttgatctattaacaatgaagaaccttgacagtaaggtgaatattataccactgattgccaaagcagacactatttctaaaaatgatttacagacgtttaagaataagataatgagtgaattgattagcaatggcatccagatatatcagctcccaacagatgaagaaactgctgctcaagcgaactcctcagttagtgggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaa

SEQ ID NO: 8337 - DNA, 570 bp, Artificial Sequence
  Description of Artificial Sequence: Synthetic polynucleotide
atggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaagacataaccagtgcggtgcaatccaagcgaagaaaatccaag

SEQ ID NO: 8338 - DNA, 3408 bp, Artificial Sequence
  Description of Artificial Sequence: Synthetic polynucleotide
atgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaag

SEQ ID NO: 8339 - DNA, 1539 bp, Artificial Sequence
  Description of Artificial Sequence: Synthetic polynucleotide
atggcggaggcgcctcctgtctcaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacagcagacaaatgcagcccaaactacctgggcagtgactggtacaacacatggaggatggaaccttacaacagcagctgctgcaacaagtataccacctaccttcctcggctgcctaaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaacct

SEQ ID NO: 8340 - DNA, 3174 bp, Artificial Sequence
  Description of Artificial Sequence: Synthetic polynucleotide
atggcggcggaaacgctgctgtccagtttgttaggactgctgcttctgggactcctgttacccgcaagtctgaccggcggtgtcgggagcctgaacctggaggagctgagtgagatgcgttatgggatcgagatcctgccgttgcctgtcatgggagggcagagccaatcttcggacgtggtgattgtctcctctaagtacaaacagcgctatgagtgtcgcctgccagctggagctattcacttccagcgtgaaagggaggaggaaacacctgcttaccaagggcctgggatccctgagttgttgagcccaatgagagatgctccctgcttgctgaagacaaaggactggtggacatatgaattctgttatggacgccacatccagcaataccacatggaagattcagagatcaaaggtgaagtcctctatctcggctactaccaatcagccttcgactgggatgatgaaacagccaaggcctccaagcagcatcgtcttaaacgctaccacagccagacctatggcaatgggtccaagtgcgaccttaatgggaggccccgggaggccgaggttcggggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagc

SEQ ID NO: 8341 - DNA, 1128 bp, Artificial Sequence
  Description of Artificial Sequence: Synthetic polynucleotide
atgaagcttgctgacagcgtaatggcagggaaagcttccgacggctccatcaaatggcagctctgctacgacatctcggccagaacttggtggatggatgaatttcatcctttcatcgaagcacttctgccccacgtccgagcctttgcctacacatggttcaacctgcaggcccgaaaacgaaaatacttcaaaaaacatgaaaagcgtatgtcaaaagaagaagagagagccgtgaaggatgaattgctaagtgaaaaaccagaggtcaagcagaagtgggcatctcgacttctggcaaagttgcggaaagatatccgacccgaatatcgagaggattttgttcttacagttacagggaaaaaacctccatgttgtgttctttccaacccagaccagaaaggcaagatgcgaagaattgactgcctccgccaggcagataaagtctggaggttggaccttgttatggtgattttgtttaaaggtattccgctggaaagtactgatggcgagcgccttgtaaagtccccacaatgctctaatccagggctctgtgtccaaccccatcacataggggtttctgttaaggaactcgatttatatttggcatactttgtgcatgcagcagtaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatt

SEQ ID NO: 8342 - DNA, 1482 bp, Artificial Sequence
  Description of Artificial Sequence: Synthetic polynucleotide
atgatgttaagaggaaacctgaagcaagtgcgcattgagaaaaacccggcccgccttcgcgccctggagtccgcggtgggcgagagcgagccggcggccgcggcagccatggcgctcgctcttgccggggagccggcaccgcccgcgcccgcgcctccagaggaccacccggacgaggagatggggttcactatcgacatcaagagtttcctcaagccgggcgagaagacgtacacgcagcgctgccgcctcttcgtgggaaatctgcccaccgacatcacggaggaggacttcaagaggctcttcgaacgctatggcgagcccagcgaagtcttcatcaaccgggaccgtggcttcggcttcatccgcttggaatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagtttggtccagtagagaaagctgttgtggttgtggatgatcgcggtagagctacaggaaaaggttttgtagagtttgcagcaaaacctcctgcacgaaaggctctggaaagatgtggtgatggggcattcttgctaacaacgacccctcgtccagtcattgtggaacccatggagcagtttgatgatgaagatggcttgccagagaagctgatgcagaaaactcaacaatatcataaggaaagagaacaaccaccacgttttgctcaacctgggacatttgaatttgagtatgcatctcgatggaaggctcttgatgaaatggaaaagcagcagcgtgagcaggttgatagaaacatcagagaagccaaagagaaactggaggcagaaatggaagcagctaggcatgaacaccaattaatgctaatgaggcaagatctaatgaggcgtcaagaagaactcagacgcttggaagaactcagaaaccaagagttgcaaaaacggaagcaaatacaactaagacatgaagaggagcatcggcggcgtgaggaagaaatgatccgacacagagaacaggaggaactgaggcgacagcaagagggctttaagccaaactacatggaaaatgaaggaatcgtgtctcctagtgacctggaccttgtcatgtcagaagggttgggcatgcggtatgcattcattggacccctggaaaccatgcatctcaatgcagaaggtatgttaagctactgcgacagatacagcgaaggcataaaacatgtcctacagacttttggacccattccagagttttccagggccactgctgagaaggttaaccaggacatgtgcatgaaggtccctgatgacccggagcacttagctgccaggaggcagtggagggacgagtgcctcatgagactcgccaagttgaagagtcaagtgcagccccag

SEQ ID NO: 8343 - DNA, 1842 bp, Artificial Sequence
  Description of Artificial Sequence: Synthetic polynucleotide
atgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagagctccttcggcattccctgcagtgcagtacctatctcagccacagccacagccctatgctgtgcatggccactttcagcccactcagacaggtttcctccagcctggtggtgccctgtccttgcaaaagcagatggaacatgctaaccagcagactggcttctccgactcatcctctctgcgccccatgcacccccaggctctgcatccagcccctggactccttgcttccccccagctccctgtgcagatgcagccagcaggaaagtcgggctttgcagctaccagccaacctggccctcggctccccttcatccaacacagccagaacccgcgattctaccacaag

SEQ ID NO: 8344 - DNA, 918 bp, Artificial Sequence
  Description of Artificial Sequence: Synthetic polynucleotide
atggtgaacctggcggccatggtgtggcgccggcttctgcggaagaggtgggtgctcgccctggtcttcgggctgtcgctcgtctacttcctcagcagcaccttcaagcaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccc

SEQ ID NO: 8345 - DNA, 1608 bp, Artificial Sequence
  Description of Artificial Sequence: Synthetic polynucleotide
atggacgcgccgcgcgcctcggcggccaagcccccgaccgggaggaagatgaaggctcgtgctcccccacctcctggaaaggctgccactctgcatgtgcacagtgaccagaagcccccccacgatggggccctcgggtcgcagcagaacttggttcgcatgaaggaggcgctgagggccagcaccatggacgtcaccgtggtcctgcctagtgggctggagaagaggagcgtgctcaatgggagccatgcgatgatggacctactggttgaactttgccttcagaaccacctgaatccatcccaccatgcccttgaaattcggtcttcagaaacccaacaacctttgagttttaagccaaatactttgattgggaccctgaatgtgcatactgtgtttctgaaagaaaaagttcctgaagagaaggttaagcctggtccccctaaggtgcctgagaaatctgtgcgtttggtcgtgaattacctgcggacacaaaaagctgttgtgcgtgtgagccctgaggttcctctccagaatattctcccagtcatttgtgcaaagtgtgaggtcagcccagagcacgtggttctcctcagggacaacattgccggagaggagctggagctgtccaagtccctgaacgagctcgggataaaggagctctacgcgtgggacaacagaagagaaacctttaggaaatcatcacttggcaatgatgagacagataaagagaagaaaaaatttctgggatttttcaaagttaataaaagaagcaatagtaaggctgagcagctcgtgctgtcgggtgcagacagcgatgaggacacctccagggctgccccaggaaggggtttgaacggctgtttaacgacccccaactccccatccatgcactcacgttctcttacgctgggtccatccctctcgctgggcagcatctcaggggtgtccgtgaagtcggagatgaagaagcgccgagcccctcctcctccaggttcagggccacctgtgcaagacaaggcatcggaaaaggggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaa

SEQ ID NO: 8346 - DNA, 588 bp, Artificial Sequence
  Description of Artificial Sequence: Synthetic polynucleotide
atgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggcactggtgccatcacacagtgacacggacggtgtcctgccaggtgcagaatggctcggagacggtggtccagcgcgtgtaccagagctgccggtggccggggccctgcgccaacctcgtaagttacaggactctgatcagacccacctacagagtgtcctaccgcacggtgacggtgctggagtggagatgctgccctggcttcaccgggagcaactgtgatgaggaatgcatgaactgcacccggctcagtgacatgagtgagcgactgaccacactggaggccaagattatttgcatgggtgcaaaagaaaatggtttgccgctggagtatcaagagaagttaaaagcaatagaaccaaatgactatacaggaaaggtctcagaagaaattgaagacatcatcaaaaagggggaaacacaaactctt

SEQ ID NO: 8347 - DNA, 2439 bp, Artificial Sequence
  Description of Artificial Sequence: Synthetic polynucleotide
atggcagcggaaacgcagacactgaactttgggcctgaatggctccgagctctgtccagtggtgggagtattacatcccctcctctttctccagcattgccgaagtataaattagcagattatcgttacggcagagaagaaatgttagcacttttccttaaagacaacaagataccttcagaccttctggataaagaatttctgcctatcctccaggaggaaccccttccaccattggctctggtaccctttacagaagaagaacagctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaa

SEQ ID NO: 8348 - DNA, 3123 bp, Artificial Sequence; identical to SEQ ID NO: 8278
  Description of Artificial Sequence: Synthetic polynucleotide

SEQ ID NO: 8349 - DNA, 2631 bp, Artificial Sequence
  Description of Artificial Sequence: Synthetic polynucleotide
atgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatgcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttg

SEQ ID NO: 8350 - DNA, 576 bp, Artificial Sequence
  Description of Artificial Sequence: Synthetic polynucleotide
atggcggagggcgcccagccgcatcagccgcctcagctcgggcccggcgccgccgcccggggcatgaagcgggagtcggagctggagctgccggtgcccggagcgggaggagacggagccgatcccggcctgagcaagcggccgcgcactgaggaggcggcggccgacggtggcggcgggatgcagggggaacttgaggttaagaacatggacatgaagccggggtcaaccctgaagatcacaggcagcatcgccgatggcactgatggctttgtaattaatctgggccaggggacagacaagctgaacctgcatttcaaccctcgcttcagcgaatccaccattgtctgcaactcattggacggcagcaactgggggcaagaacaacgggaagatcacctgtgcttcagcccagggtcagaggtcaagttcacagtgacctttgagagtgacaaattcaaggtgaagctgccagatgggcacgagctgacttttcccaacaggctgggtcacagccacctgagctacctgagcgtaaggggcgggttcaacatgtcctctttcaagttaaaagaa

SEQ ID NO: 8351 - DNA, 1326 bp, Artificial Sequence
  Description of Artificial Sequence: Synthetic polynucleotide
atggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctggcgttccttctgctgctattggatcctttcctaatgctgctgcattttttatcacctatgaatatgtgaagtggtttttgcatgctgattcatcttcatatttgacacctatgaaacatatgttggctgcctctgctggagaagtggttgcctgcctgattcgagttccatctgaagtggttaagcagagggcacaggtatctgcttctacaagaacatttcagattttctctaacatcttatatgaagagggtatccaagggttgtatcgaggctataaaagcacagttttaagagagatagaagaagtcagagatgccatggaaaatgaaatgagaacccagcttcgccgacaggcagctgcccacactgatcacttgcgagatgtccttagggtacaagaacaggaattgaagtctgaatttgagcagaacctgtctgagaaactctctgaacaagaattacaatttcgtcgtctcagtcaagagcaagttgacaactttactctggatataaatactgcctatgccagactcagaggaatcgaacaggctgttcagagccatgcagttgctgaagaggaagccagaaaagcccaccaactctggctttcagtggaggcattaaagtacagcatgaagacctcatctgcagaaacacctactatcccgctgggtagtgcagttgaggccatcaaagccaactgttctgataatgaattcacccaagctttaaccgcagctatccctccagagtccctgacccgtggggtgtacagtgaagagacccttagagcccgtttctatgctgttcaaaaactggcccgaagggtagcaatgattgatgaaaccagaaatagcttgtaccagtacttcctctcctacctacagtccctgctcctattcccacctcagcaactgaagccgcccccagagctctgccctgaggatataaacacatttaaattactgtcatatgcttcctattgcattgagcatggtgatctggagctagcagcaaagtttgtcaatcagctgaagggggaatccagacgagtggcacaggactggctgaaggaagcccgaatgaccctagaaacgaaacagatagtggaaatcctgacagcatatgccagcgccgtaggaataggaaccactcaggtgcagccagag

SEQ ID NO: 8352 - DNA, 828 bp, Artificial Sequence
  Description of Artificial Sequence: Synthetic polynucleotide
atgggagtccccaagttttacagatggatctcagagcggtatccctgtctcagcgaagtggtgaaagagcatcaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcc

SEQ ID NO: 8353 - DNA, 1437 bp, Artificial Sequence
  Description of Artificial Sequence: Synthetic polynucleotide
atggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcagcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaagacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggac

SEQ ID NO: 8354 - DNA, 1917 bp, Artificial Sequence
  Description of Artificial Sequence: Synthetic polynucleotide
atgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatggggttatgatcatagctactacttcattgcaacctttattactgaccacatcagacatcatgctaaatacctgaatgca

SEQ ID NO: 8355 - DNA, 3141 bp, Artificial Sequence
  Description of Artificial Sequence: Synthetic polynucleotide
atggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttact

SEQ ID NO: 8356 - DNA, 2241 bp, Artificial Sequence
  Description of Artificial Sequence: Synthetic polynucleotide
atggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcagatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagca

SEQ ID NO: 8357 - DNA, 1944 bp, Artificial Sequence
  Description of Artificial Sequence: Synthetic polynucleotide
atgaataacctaaatgatcccccaaattggaatatccggcctaattccagggcggatggtggtgatggaagcaggtggaattatgccctgttggttccaatgctgggattggctgcttttcgggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggac

SEQ ID NO: 8358 - DNA, 5814 bp, Artificial Sequence
  Description of Artificial Sequence: Synthetic polynucleotide
atgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcggagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaact

SEQ ID NO: 8359 - DNA, 216 bp, Artificial Sequence
  Description of Artificial Sequence: Synthetic polynucleotide
atggcccggggctacggggccacggtcagcctagtcctgctgggtctggggctggcgctggctgtcattgtgctggctgtggtcctctctcgacaccaggccccatgtggcccccaggcctttgcccacgctgctgttgccgccgactccaaggtctgctcggatattggacggcaggaaactgcatatcttctggtttacatgaagatggagtgc

SEQ ID NO: 8360 - DNA, 939 bp, Artificial Sequence
  Description of Artificial Sequence: Synthetic polynucleotide
atgtttgtgtatgtgctcactcccggagagcaatcagggagacggctccccggccagacttggctgatgttttcttgtttctgtttcagccttcaggataattccttcagcagcaccactgtaacagagtgtgacgaagatccagtctctctacatgaagaccagactgattgctccagtctcagagatgaaaacaataaagagaactaccccgacgcaggggctctggtagaagagcacgcgccgccctcttgggagccgcagcagcagaatgtagaggcgaccgtgctggtggacagcgtattgcgacccagcatgggcaacttcaagtccaggaagcccaagtccatcttcaaagcggagagcgggaggagccacggagaaagtcaggagacagagcatgtggtatccagccagtcagagtgtcaggtgagagcaggaacaccagctcatgagagtccacaaaacaatgccttcaagtgccaagaaacagtgcgacttcaaccaaggagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacac

SEQ ID NO: 8361 - DNA, 8478 bp, Artificial Sequence
  Description of Artificial Sequence: Synthetic polynucleotide
atgcactcagccgggactcccgggttatcctcgcgccggacaggcaactccaccagctttcaaccaggaccgccaccgccgccccggctgctgctgctgctgctgcttctcctgtcactggtaagccgcgtcccggcacagcccgctgccttcggcagggcgttgctgtcccctggtctcgcgggggctgcaggggtccctgctgaggaggccatagtgctggcgaaccgcggactccgggtgcctttcggccgtgaagtctggctggatcccctgcatgacctggtgttgcaggtgcagcccggggaccgctgcgcggtttcggtactagacaacgacgcactggcccagcgaccgggccgcctgagtcccaagcgcttcccgtgcgactttggccctggcgaggtgcgctactctcacctgggcgcgcgcagcccgtctcgggaccgcgtccggctgcagctgcgctatgacgcgcccggaggggcagtagtgctaccactggtactggaggtggaggtggtcttcacccagctggaggttgtgactcggaacttgcctctggtcgtggaagagctgctggggaccagcaatgccctggacgcgcggagcctggagttcgccttccagcccgagacagaggagtgccgcgtgggcatcctgtccggcttgggcgcgctgcctcgctatggagaactcctccactacccgcaggtccctggaggagccagagagggaggcgccccggagactctcctgatggactgcaaagctttccaggaactaggcgtgcgctatcgccacacagccgccagtcgctcaccaaacagggactggatacccatggtggtggagctgcgttcacgaggggctcctgtgggcagccctgctttgaaacgcgagcacttccaggttctggtgaggatccgaggaggggccgagaacactgcacccaagcccagtttcgtggccatgatgatgatggaggtggaccagtttgtactgacggccctgaccccagacatgctggcagccgaggatgctgagtctccctctgacctgttgatcttcaaccttacttctccattccagcctggccagggctacttggtgagcaccgatgatcgcagcctgcccctttcctccttcactcagagggatctgcggctcctgaagattgcctaccagcccccttctgaagactctgaccaggagcgcctctttgaactggaattggaggtagtggatctagaaggagcagcttcagacccttttgccttcatggtagtggtgaagcccatgaacacaatggctccggtggtcacccggaataccggtcttattctctatgagggtcagtctcggcccctcacaggccctgcaggcagtggtccgcaaaacttggtcatcagcgatgaggatgacctagaagcagtgcggctagaggtggtggctgggctccggcatggtcaccttgtcattctgggtgcttccagtggcagctctgctcccaagagctttacagtggctgagctggcagccggccaggtggtctaccagcatgatgacagagacggctcgctgagcgacaacctggtgcttcgcatggtggatggaggaggcaggcaccaggtacagtttctgttccccatcaccttagtgcctgtggatgaccagccacctgttctcaatgccaacacggggctgacactggcagagggtgaaacagtgcccatcctgcccctttccctgagtgcaactgacatggattcagatgattctctgctgctttttgtgctggagtcacccttcttaactacggggcatctgcttctccgccaaactcaccctccccatgagaagcaggaacttctcagaggcctttggaggaaggagggggcattttatgagcgaacagtgacagagtggcagcagcaggacataacagagggcaggctgttctatagacactctgggccccatagtcctgggccagtcacagaccagttcacatttagagtccaggataaccatgaccctcctaatcagtccgggctacagcggtttgtgattcgtatccatcctgtggatcgcctccctccggagctgggcagtggctgtccccttcgtatggtggtacaggaatcccagctcacaccactgaggaagaagtggctgcgctacactgacctggacacagatgaccgagaactacgttacacagtgactcagtcccccacagacacagacgaaaatcacctgccagccccactgggtaccttggtcttgactgacaacccctcagtcgtggtgacccattttacccaagcccagatcaaccatcataaaattgcttacagacccccgggtcaagaactgggcgtggctactcgagtggcccagttccagttccaggtggaagaccgagctgggaatgtggctccaggtacctttaccctttacttgcatcccgtggacaaccagccacctgagatcctcaacaccggcttcactattcaggagaagggtcaccacatcctgagtgagacagagttgcacgtgaatgatgtagacactgatgttgcccatatctctttcactctcactcaggcacccaaacatggccacatgagagtgtctggacagatcctgcatgtagggggtctcttccacttggaggacataaaacagggccgagtttcctatgcccataatggggacaagtccctgactgatagctgctccttggaagtcagtgacagacatcatgtggtgcccatcactctcagagtaaatgtccggccagtggatgatgaagtgcccatactgagccatcctactggcactctggagtcctatctagatgtcttagaaaatggggctactgaaatcactgccaatgttattaaggggaccaatgaggaaactgatgacttgatgttgactttcctcttggaagatccacctttgtatggggaaatcttggtcaatggcattccagcagagcagtttactcaaagggacatcttggagggctctgttgtatatacccacaccagtggtgagataggcctattgcctaaagcggattcttttaacctgagtctgtcagatatgtctcaagaatggagaattggtggcaatactatccaaggagttactatatgggtgaccatcctgcctgttgatagccaggccccagaaatctttgtaggtgaacagttgatagtaatggaaggtgataaaagtgttataacatcagtgcatataagtgctgaagatgtcgactccctgaatgatgacatcttgtgcactatagttattcagcctacttcaggttatgttgaaaacatttctccagcaccaggctctgagaaatcaagagcagggattgccataagtgctttcaacttgaaagatctcaggcagggccacataaactatgtccagagtgtccataaaggggtggaacctgtggaggaccgatttgtatttcgttgttctgatggcattaacttttcagagagacagttcttccccattgtaatcattcccaccaatgatgaacagccagagatgtttatgagagaatttatggtgatggaaggcatgagtctggtaattgatacacccattctcaatgctgctgatgctgatgttcccctggatgatttaactttcactattacccaattccccactcatggtcacatcatgaatcagctgataaatggcacggttttggtcgaaagcttcaccttggatcagatcatagagagttccagcattatttatgagcatgatgactccgagacccaggaagacagttttgtgattaaactaacagatgggaagcactctgtggaaaagacggtcctcattatagttatccctgttgatgatgagacgcccagaatgactatcaataatggactagaaatagaaattggggataccaagattatcaacaacaaaatattaatggcaacagatttagattcagaagacaaatctttggtttatattattcgttatgggccaggacatggcttattacagagacgaaaacctactggtgcctttgaaaatatcacactgggcatgaattttacccaggatgaagtagacagaaacttaattcagtatgtccatttggggcaagagggcattcgggacctaattaaatttgatgtgactgatggaataaatcccctcatagatcgttacttttatgtgtccatcgggagcattgacattgtcttccctgatgtgataagtaagggagtgtccttgaaagaaggtggcaaagtcactcttacaacagacctactaagcactagtgacttgaacagtcctgatgaaaacttggtttttaccatcaccagggctcccatgcgaggtcacctggaatgcacggatcagcctggtgtgtccatcacgtctttcactcagctgcaactggctggaaacaaaatctactacatccacacagctgatgatgaagtgaaaatggacagttttgagtttcaagtcaccgatggacgtaaccctgtctttcggacattccgtatctccattagcgatgtggacaataaaaagccagtggtcaccatccacaagctggttgtcagtgaaagtgaaaacaagctgattactccttttgagctcactgtcgaagacagagatactcctgacaagctcctgaaattcactatcacccaggtgcctattcatggccatctcctattcaacaataccagacctgtcatggtttttaccaagcaagacttgaatgaaaacttaatcagctacaaacatgatggcactgagtcaagtgaagatagcttctccttcacagtgactgatggcacccatacagacttctatgtttttcctgatacggtgtttgaaacaaggagaccccaagtgatgaagatccaggtcttggctgttgacaacagtgtcccccaaatcgcagtgaataagggggcctctacacttcgcactctagccactggccacttggggttcatgatcacaagcaaaatattgaaagtggaggacagagacagcttacacatttctcttagatttatcgtgacagaggcccctcaacatggatatcttctcaacctggacaaaggcaaccacagcatcactcagttcacacaagctgacattgatgacatgaaaatatgctatgtcttaagagaaggggctaatgccacaagtgatatgttctattttgcagttgaagatggtggtggaaacaagttaacgtaccagaattttcgtctgaattgggcatggatctcctttgaaaaggaatattacctggtcaatgaggactccaaatttctagatgttgttcttaaacgtagaggttacttgggagaaacttcttttataagtattggcacaagagacagaactgcagaaaaagacaaagacttcaagggcaaagcacagaaacaagtgcagttcaacccaggccagaccagggccacatggcgagtgcggatcctgagtgatggggagcatgagcagtctgaaacctttcaggtggtactctcagagcccgtgctggctgccttggaattccccacagtcgccactgttgagatcgttgatccaggagatgagccaactgtgtttattccccagtccaaatactccgttgaagaagatgttggtgagctgttcattcccatcaggaggagcggagatgtgagccaggagttgatggtggtctgttatacccaacaaggaacagcaactggaactgtgccgacttccgtgttgtcttactctgattacatatccaggcctgaggaccacaccagtgttgtccgctttgacaaagatgaacgggagaaactgtgtcggatagtcataattgatgactctttgtacgaggaggaggaaaccttccatgtccttctgagcatgcccatggggggaagaatcggatcagagttcccaggggctcaagttacaatcgttcctgacaaagatgatgaacccatcttttacttcggtgatgtggaatactctgtggatgagagtgctggctatgtggaagtgcaggtgtggagaacgggcactgacctgtccaagtcttctagtgtcacagtgaggtctcggaaaacagatcctccctctgcagatgctggaacagactatgtgggcatcagccgtaatttagattttgcacctggagtcaacatgcagcctgttcgtgttgtcattctggatgaccttggacaaccagcgctggagggaattgagaaatttgaactggtgcttcgcatgcctatgaacgcagcccttggcgagcccagcaaagccacagtgtccataaatgactctgtctccgatttgcctaagatgcaattcaaagaacgaatatatactggcagcgaaagtgatgggcagatagttacaatgatccataggactggggatgtccagtacagatcttcagtgagatgctacacccggcaggggtctgcacaggtgatgatggactttgaagaacgcccaaacactgatacctccatcatcacattcctccctggtgagacagaaaagccctgcattcttgagctgatggacgatgtgctctatgaggaggtagaggagctccgcctggtactcggcactccacaaagcaactctccctttggggctgcagttggtgaacaaaatgaaactctcataaggatccgagatgatgctgataagactgttattaaatttggagaaaccaaatttagtgtcactgaacccaaagaacctggagagtcggtggttataagaattccagtgattcgccaaggagacacttcaaaggtttccattgtgagagtccacaccaaggatggctcggccacctctggagaagactaccaccctgtgtcagaagaaattgagtttaaggaaggggaaacccagcacgtggttgaaatcgaagttacctttgacggggtgagagagatgagagaggccttcactgttcacctaaaacctgatgaaaatatgatagcagagatgcagttgacgaaagccattgtgtacatagaagaaatgagcagcatggcagatgtcacttttccttctgtccctcaaattgtatccctgttgatgtatgacgacacttccaaagctaaggagagtgctgaacccatgtctggctatcctgtcatctgtatcacagcttgcaaccccaaatattcagactacgataaaacaggctctatctgtgcaagtgagaacatcaatgacactttgacgcggtaccggtggctgattagtgcacctgcgggccctgacggtgtgaccagccctatgagagaagtggacttcgacaccttttttacgtcatccaagatggtcacactggactccatatactttcagcctggctcccgggtacagtgcgcagctcgtgctgtgaacaccaatggggatgaaggcctggagctcatgagccctattgtaaccatcagcagagaagaaggtctttgtcagccccgtgtacctggggttgttggagcagagccgttctcagctaaattgcgctacacaggccctgaggatgcagactacacaaaccttatcaagctcactgtcacaatgccacacatagatggcatgctccccgtgatctccactagagagctttccaactttgagctcaccctcagccctgatggcacaagagttggaaaccacaagtgctccaacctcctggattatactgaagtgaagactcattatggtttcttgactgatgctaccaaaaatccagaaataattggagagacatatccttaccagtacagcttgtccatcagaggttccactaccttgcgcttctaccggaacctgaacctagaggcctgtttatgggagttcgttagctactatgacatgtcagaactccttgctgactgtggtggcaccattggaacagatggacaggtggatgtgaaattggaccccaaggatttgcgaatagatacatttcgagccaaaggagcaggagggcagcatgttaataaaactgatagtgccgtcagacttgtccacatccccacagggctagtagtagaatgccaacaagaaagatcacagataaaaaataaagaaatagcctttcgtgtgttgagagctagactctaccagcagattattgagaaagacaagcgtcagcaacaaagtgctagaaaactgcaggtgggaacaagagcccagtcagagcgaattcggacatataatttcacccaggatagagtcagtgaccacaggatagcatatgaagttcgtgatattaaggctcagtctcattccacgggtggtagtcgtgaccctgcacattccacattcctatccttggattctgtgagatcacctggtattctcattatgacttcttctgttaggaatttttatgtggtgggaagggcctggatcagc

SEQ ID NO: 8362 - DNA, 1635 bp, Artificial Sequence
  Description of Artificial Sequence: Synthetic polynucleotide
atggccatagaccggcggcgcgaggcggcgggcggcgggcctgggcggcagccggccccggccgaggagaacggctccctgccgcccggggacgcggcggcctcggcgcccctcgggggacgcgcgggccccggcggcggcgcggagatccagccgctgcccccactgcatcctggaggcggcccgcacccgagctgctgctccgcggctgcggccccgagcctcttgttgctggactatgacgggtcggtgctgcccttcctcgggggcctgggcgggggctatcagaagaccctcgtgctgctcacctggatcccggcgctgttcatcggcttcagccagttctcggactcgttcctcctggaccagcccaacttctggtgccgcggggccggcaaaggcaccgagctggcaggggtcaccaccacaggccggggcggggacatgggcaactggaccagcctccccaccacccccttcgccactgccccctgggaggctgcgggcaaccggagcaacagcagcggcgcggacggaggcgacacaccacccctgccatcccctccggacaagggggacaacgcctccaactgtgactgccgcgcatgggactacggcatccgcgccggcctcgtccagaacgtggtcagcaagtgggatcttgtgtgtgataatgcctggaaggtccatatcgctaagttctccttactggttggattaatctttggctacctaataactggatgcattgctgactgggtcggccggcggcctgtgctgctgttttccatcatcttcattctgatctttggactgactgtggcactgtcagtgaatgtgacaatgttcagcacactcaggttctttgaaggattttgcctggctggaatcattctcaccttgtatgctttacgtatcgatatcctgaagcttgtagcagcccaagtgggaagccagtggaaagatatctatcagtttctttgcaatgccagtgagagggaggttgctgctttctccaatgggtacacagccgaccacgagcgggcctacgcagctctgcagcactggaccatccggggccccgaggccagcctcgcccagctaattagcgccctgcgccagcaccggagaaacgatgttgtggagaagattcgtgggctgatggaagacaccacccagctggaaactgacaaactagctctcccgatgagccccagcccgcttagcccgagccccatccccagccccaacgcgaaacttgagaattccgctctcctgacggtggagccttccccacaggacaagaacaagggcttcttcgtggatgagtcggagccccttctccgctgtgactctacatccagcggctcctccgcgctgagcaggaacggttcctttattaccaaagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctg

SEQ ID NO: 8363 - DNA, 1290 bp, Artificial Sequence
  Description of Artificial Sequence: Synthetic polynucleotide
atggaaaacactgatcgaaaagtatcctccttgcacacctcccgagttcagaggcagatggtggtctccgttcacgacttacccgagaagagctttgtgcccctgctggacagcaaatacgtcctctgtgtgtgggatatttggcagccttcagggccacagaaagttctgatatgtgagtcccaggtcacgtgttgctgcttgagccctttgaaagcatttttactgtttgccggaacagcgcacggctcagttgtcgtctgggatttgagagaagactcaaggctgcattactctgtgacgctgagcgatggcttctggacgttccggaccgccacgttttccaccgatggaatccttacctcagtaaaccaccgaagccctcttcaagcagtagaacctatctcaacgtccgtccacaaaaagcagagctttgtgctttcacccttttctactcaagaagaaatgtcaggtttgtccttccacatcgcttccttggatgagagtggggttctcaatgtatgggtggttgttgaattaccaaaggcagacatcgcaggttcaataagtgatttaggtctgatgcctggagggagggtcaagctggtacatagtgctctgatccagttgggtgacagtctttcccataaaggtaatgaattttggggcactacacaaacactgaatgttaaatttctgccttcagatcctaatcactttattattggcacagacatgggtctcataagccatggcacaagacaagatttgagagtggctcccaaactattcaaacctcagcaacatggtataagaccagtgaaagttaatgtcattgatttttcaccatttggagaaccaatatttttggccggctgttcggacggaagcatcaggctgcaccagctgagctccgcgtttccgctcctgcagtgggacagcagcacggacagccatgcggtcaccggcctgcagtggtccccaaccaggcctgccgtgttcctggtgcaggacgacacatccaacatctacatctgggacctcctccagagcgatctgggtcctgtcgccaaacagcaggtctcccccaacaggctggtggccatggctgcggtgggtgagcctgagaaggctggtggcagcttcctggccctggtgctggccagggcgtctggctccatcgacatccagcacctgaagaggcggtgggcggccccggaggtggacgagtgcaacaggctgcgtctgcttttgcaggaagccctgtggccagagggaaaactgcacaag

SEQ ID NO: 8364 - DNA, 1326 bp, Artificial Sequence
  Description of Artificial Sequence: Synthetic polynucleotide
atgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcctagcaaagagcagctagaaaagctagcaaggaggagggcgctagaagaggagttagaggacttggagttaggcctc

SEQ ID NO: 8365 - DNA, 2310 bp, Artificial Sequence
  Description of Artificial Sequence: Synthetic polynucleotide
atggctgctgagaagcaggtcccaggcggcggcggcggcggcggcagtggcggcggcggtggcagtggcggcggcggtagcggcggtggacgtggtgccggaggggaagaaaataaagaaaacgaacgcccttcggccggatcgaaggcaaacaaagaatttggggatagcctgagtttggagattcttcagattattaaggaatcccagcagcagcatggtttacggcatggagattttcagaggtacaggggctactgttcccgtagacaaagacgtcttcgaaaaacactcaacttcaagatgggtaacagacacaaattcacagggaagaaagtgactgaagagcttctgaccgataatagatacttgcttctggttctgatggatgctgaaagagcctggagctacgccatgcagctgaaacaggaagccaacactgaaccccgaaaacggtttcacttgttatctcgcctacgcaaagccgtgaagcatgcagaggaattggaacgcttgtgtgagagcaatcgcgtggatgccaagaccaaattagaggctcaggcttacacagcttacctctcaggaatgctacgttttgaacatcaagaatggaaagctgccattgaggcttttaacaaatgcaaaactatctatgagaagctagccagtgctttcacagaggagcaggctgtgctgtataaccaacgtgtggaagagatttcacccaacatccgctattgtgcatataatattggggaccagtcagccatcaatgaactcatgcagatgagattgaggtctgggggcactgagggtctcttggctgaaaaattggaggctttgatcactcagactcgagccaaacaggcagctaccatgagtgaagtggagtggagagggagaacggttccagtgaagattgacaaagtgcgcattttcttattaggactggctgataacgaagcagctattgtccaggctgaaagcgaagaaactaaggagcgcctgtttgaatcaatgctcagcgagtgtcgggacgccatccaggtggttcgggaggagctcaagccagatcagccattgatcagccgcaactacaagggcgatgtggccatgagcaagattgagcacttcatgcctttgctggtacagcgggaggaggaaggcgccctggccccgctgctgagccacggccaggtccacttcctatggatcaaacacagcaacctctacttggtggccaccacatcgaagaatgccaatgcctccctggtgtactccttcctgtataagacaatagaggtattctgcgaatacttcaaggagctggaggaggagagcatccgggacaactttgtcatcgtctacgagttgctggacgagctcatggactttggcttcccgcagaccaccgacagcaagatcctgcaggagtacatcactcagcagagcaacaagctggagacgggcaagtcacgggtgccacccactgtcaccaacgctgtgtcctggcgctccgagggtatcaagtataagaagaacgaggtcttcattgatgtcatagagtctgtcaacctgctggtcaatgccaacggcagcgtccttctgagcgaaatcgtcggtaccatcaagctcaaggtgtttctgtcaggaatgccagagctgcggctgggcctcaatgaccgcgtgctcttcgagctcactggcctttcaggcagcaagaacaaatcagtagagctggaggatgtaaaattccaccagtgcgtgcggctctctcgctttgacaacgaccgcaccatctccttcatcccgcctgatggtgactttgagctcatgtcataccgcctcagcacccaggtcaagccactgatctggattgagtctgtcattgagaagttctcccacagccgcgtggagatcatggtcaaggccaaggggcagtttaagaaacagtcagtggccaacggtgtggagatatctgtgcctgtacccagcgatgccgactcccccagattcaagaccagtgtgggcagcgccaagtatgtgccggagagaaacgtcgtgatttggagtattaagtctttcccggggggcaaggagtacttgatgcgagcccactttggcctccccagtgtggaaaaggaagaggtggagggccggccccccatcggggtcaagtttgagatcccctacttcaccgtctctgggatccaggtccgatacatgaagatcattgagaaaagtggttaccaggccctgccctgggttcgctacatcacccagagtggcgattaccaacttcgtaccagc

SEQ ID NO: 8366 - DNA, 1386 bp, Artificial Sequence
  Description of Artificial Sequence: Synthetic polynucleotide
atgtcgctgctgcggtcgctgcgcgtgtttctggtcgcgcggaccgggagctacccggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggcagagatctggctccacaaggaggcccagaaggagggctggagcaaagctgccaagctccaagggaggaagaccaaagaaggcctgattgggctgttgcaggaaggaaacacaactgtattagtagaggtaaactgtgagacagattttgtttctagaaatttaaaatttcaactgttggtccagcaagtagcccttggaaccatgatgcattgtcagaccctaaaggatcaaccctctgcatacagtaaagtgcagtggctcacgcctgtaaacctagcactttgggaggctgaagcaggtggatcacttgagggtttcttgaattcctctgagctttctggacttccagctgggcctgacagagaaggctcactcaaggatcagttggctttagcaattgactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagc

SEQ ID NO: 8367 - DNA, 2790 bp, Artificial Sequence
  Description of Artificial Sequence: Synthetic polynucleotide
atggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaaatttgttattgggcgggaaaaaccaggacaagtgagcgaggttgcccagttgataagccagacactggaacaggagaggcgccagagagagctgctggaacagcactatgcccagtatgatgccgacgatgacgagaacactgtggctgaattgcaaggaatgtctggcaactgcaataacaataacaactattttcttaagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaataattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcag

SEQ ID NO: 8368 - DNA, 2166 bp, Artificial Sequence
  Description of Artificial Sequence: Synthetic polynucleotide
atgcagagcacgcaggcccatgagaacagcagggatagccggctggcatggatgggcacctgggagcaccttgtgtctactggattcaaccagatgcgtgagcgcgaagtgaagctgtgggacacgcggttcttctccagcgccctggcctccctcaccttggacacctcgcttgggtgtctcgtgcctctgctggaccctgactctgggctcctggtcctggcaggaaagggcgagaggcagctgtactgttacgaggtggtcccgcagcagccggcgctgagcccagtgacccagtgtgtcctggagagcgtgctgcgtggggctgcccttgtgccccggcaggcgctggccgtcatgagctgcgaggtactccgcgtcctacagctgagcgacacagccatcgtgcccatcggctaccatgtgccccgcaaggctgtggagttccacgaggacctgttcccggacactgccggctgtgtgcctgccaccgacccccatagctggtgggctggggacaaccagcaggtgcagaaggtcagcctcaaccccgcctgccggccccacccgagcttcacttcctgtctggtgccccctgcggagcccctccctgacacagcccagcctgcggtgatggagacacccgtgggtgatgcagacgcaagcgagggtttctcttcccctcccagttcgctgacctcgccctccacgccctccagcctggggccctcactctccagcaccagtggcatcgggaccagccccagtttgaggtcgctgcagagcctgctgggccccagttccaagttccgccatgctcagggcactgtcctgcaccgagacagccacatcaccaacctcaaggggctcaacctcaccacacctggtgagagtgacggcttctgtgccaacaagctgcgtgtggccgtgccgctgctcagcagcgggggacaggtggctgtgcttgagctacggaagcctggccgcctgcccgacacggcactgcccacgctgcagaatggggcagctgtgactgatctggcctgggacccctttgacccccatcgcctcgctgtggctggtgaggacgccaggatccgactgtggcgggtacccgcagagggcctggaagaggtgctcaccacgccagagactgtgctcacaggccacacggagaagatctgctccctgcgcttccacccactggcagccaatgtgctggcctcgtcctcctatgacctcactgttcgcatctgggaccttcaggctggagctgatcggctgaagctgcagggccaccaagaccagatcttcagcctggcctggagtcctgatgggcagcagctggccactgtctgcaaggatgggcgtgtgcgggtctacaggccccggagtggccctgagcccctgcaggaaggcccagggcccaagggaggacgcggagctcgcattgtctgggtatgtgatggtcgctgtctgctggtgtctggctttgacagccaaagtgagcgccagctgctcctatatgaagctgaggccctggccggcggacccttggcagtgttgggcctggacgtggctccctcaaccctgctgcccagctacgacccagacactggcctggtgctcctgaccggcaagggcgacacccgtgtattcctgtacgagctgctccccgagtcccctttcttcctggagtgcaacagcttcacgtcgcctgacccccacaagggcctcgtcctcctgcctaagacggagtgcgacgtgcgggaagtggagctgatgcggtgcctgcggctgcgtcagtcctccctggagcctgtggccttccggctgccccgagtccggaaagagttcttccaggatgacgtgttcccagacacggctgtgatctgggagcctgtgctcagtgccgaggcctggctgcaaggcgctaatgggcagccctggcttctcagcctgcagcctcctgacatgagcccagtgagccaagccccccgagaggcccctgctcgtcgggccccatcctcagcgcagtacctggaagaaaagtctgaccagcaaaagaaggaggagctgctgaatgccatggtggcaaaactggggaaccgggaggacccactcccccaggactcctttgaaggcgtggacgaggacgagtgggac

SEQ ID NO: 8369 - DNA, 309 bp, Artificial Sequence
  Description of Artificial Sequence: Synthetic polynucleotide
atgggcgagaccatgtcaaagaggctgaagctccacctgggaggggaggcagaaatggaggaacgggcgttcgtcaaccccttcccggactacgaggccgccgccggggcgctgctcgcctccggagcggccgaagagacaggctgtgttcgtcccccggcgaccacggatgagcccggcctcccttttcatcaggacgggaaggatgctttcattggatttggaggaaatgtgatcaggcaacaagtcaaggataacgccaaatggtatatcactgattttgtagagctgctgggagaactggaagaa

SEQ ID NO: 8370 - DNA, 1293 bp, Artificial Sequence
  Description of Artificial Sequence: Synthetic polynucleotide
atgccgcagtccaagtcccggaagatcgcgatcctgggctaccggtctgtggcctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggctggtggtggtaaatgaagcagatagtattgtgggtattatttccctgtcggacattctgcaagccctgatcctcacaccagcaggtgccaaacaaaaggagacagaaacggag

SEQ ID NO: 8371 - DNA, 1188 bp, Artificial Sequence
  Description of Artificial Sequence: Synthetic polynucleotide
atgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacatagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcc

SEQ ID NO: 8372 - DNA, 5070 bp, Artificial Sequence
  Description of Artificial Sequence: Synthetic polynucleotide
atggcggaacgaggcctggagccgtcgccggccgcggtggcggcgctgccgcctgaagtgcgggcgcagctggcggagctggagctggagctctcggagggggacatcacccagaagggctatgaaaagaaaaggtccaaactcctatctccttacagcccgcagacacaagaaactgattcagcagtacagaaagaacttagaaaccagacacctgctccatctgcagctcaaacttctgctccctctaagtaccaccgaactcgatctgggggagccagggatgaacgatatcgatcagatatccacacagaagcagttcaggctgcactggcaaagcataaagaacagaagatggctttgcccatgccaaccaaaaggcgatccacatttgttcagtctcctgcagatgcctgcacacctcctgacacatcttcggcctctgaggatgagggctctctgagacgccaagctgcgctctctgctgccttgcaacagagcttacagaatgctgagtcctggatcaaccgttcaattcagggatcgtccacttcttcatccgcatcttctacgctgtcccacggagaggtcaaaggaaccagtgggtctctagctgatgtatttgccaatactcgaatagagaatttctctgctcctcctgatgtcactacaactacctcttcctcctcatcatcttcctcaattcgcccagcaaacattgacctgcccccctcggggatagttaaaggcatgcacaaaggatccaacaggtccagccttatggatacagctgatggtgttcctgtcagtagcagagtatctacaaaaatccagcagcttctgaacactctgaaacgacccaaaaggcctcccttaaaggaattttttgtggatgactctgaagaaattgtggaagtacctcagccagaccccaaccagcccaagccggagggacggcagatgacccctgtgaaaggagagcctttaggagtcatctgtaactggcctcctgctcttgaatctgccctgcagcgctggggtaccactcaagcaaaatgctcctgtctgactgcactggacatgacagggaaaccagtttacactcttacatatggaaagttgtggagcagaagtttaaagttggcctacacacttcttaataaactggggaccaaaaatgaacctgtgttaaaacctggagacagggtagccctggtttaccccaacaatgatccagtcatgtttatggtggctttctatggatgcctcctggcagaagtgattccagtgcctatagaggtacctcttaccagaaaggatgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggggaaacaatagtaaatgtcttagactttaagaaggatgctgggctgtggcacggcatgtttgcgaatgtaatgaataagatgcacacaatcagcgtaccctactctgttatgaaaacctgtcctctctcttgggtccaaagagtacatgctcacaaagccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcagaaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagacagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccgg

SEQ ID NO: 8373 - DNA, 1689 bp, Artificial Sequence
  Description of Artificial Sequence: Synthetic polynucleotide
atggaaccccccgcggccaagcggagccggggctgccccgcgggacccgaggagcgcgatgccggggccggggccgcgcgtggccggggccggcccgaggcgctgctggacctcagcgccaagcgggtagccgagagctgggccttcgagcaggtggaggagcggttctcccgggtgcctgagcccgtccagaagcgcatcgtgttttggtcgtttccacgcagtgaacgggaaatatgtatgtactcgtcgctgggttacccgcccccagagggcgagcacgatgcccgggtgccctttacccgcgggctgcacctgctccagagcggggccgtggaccgcgtgttgcaagtgggattccacctgagcggaaacatccgcgagccagggagtcctggagagcccgagcgcctctaccatgtctccatcagctttgatcgctgcaagatcacgtccgtgagctgcggctgtgacaaccgcgacctcttctactgtgcccacgtggtggccctgtccctgtaccgcattcggcacgcccaccaggtggagctgcggctgcccatctccgagacgctctcccagatgaaccgggaccagctgcagaagttcgtgcagtacctcatcagcgcccatcacactgaggtgctgcccactgctcagcgcttggctgatgagatcctcctgctgggctccgagatcaacttggtgaatggtgccccagaccccaccgccggcgcaggaatcgaggacgccaactgctggcacctggacgaggagcagatccaggagcaggtgaagcagctactgtccaatggcggctactacggggccagccagcagctgcgctccatgttcagcaaggtgcgggagatgctgcgaatgcgggactccaacggggcgcgcatgctgattctcatgaccgagcagttcctgcaggacacgcgcctggccctgtggcggcagcagggcgcgggcatgacggacaagtgccggcagctctgggatgagctggggatgttcaatagcccagaaatgcaagccctcctccagcagatctctgagaacccccagctgatgcagaatgtgatctcagcaccctacatgcgcagcatgatgcagacgcttgcccagaaccccgactttgctgctcagatgatggtgaatgtgccgctcttcgcggggaacccccaactgcaggagcagctccgcctgcagctcccagtcttcctgcagcagatgcagaacccagagtcactctccatccttaccaatccccgagccatgcaggcattgctgcagatccagcagggactacagaccttgcagaccgaggcccctgggctggtacccagccttggctcctttgggatatcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtgcagacgccagaagtgagatttcagcagcagctggagcagctcaactccatgggcttcatcaatcgtgaggctaacctgcaggccctgattgccacaggaggggacatcaacgcagctatcgagagactgctgggctcccagctctcc

SEQ ID NO: 8374 - DNA, 2718 bp, Artificial Sequence
  Description of Artificial Sequence: Synthetic polynucleotide
atggacgtccttcccaccggcgggggccgcccggggctccggacggagctggaattccgcggcggcggtggcgaggcgaggctggagagtcaggaggaagaaacgattcctgcagctcccccagccccgcgcctccggggagcggcggagcggccgcggcgctcccgggacacgtgggacggcgatgaggacacggagcccggcgaggcgtgcggcggccgcacaagccgcacggcgtccctggtgagcgggctgctcaacgagctgtacagctgcacagaggaggaggaggcggcgggcgggggccgcggggccgagggccgccggcggcgccgcgacagcctcgacagctccaccgaggcctcgggctccgacgtggtcctgggcggccgcagcggtgccggcgactcccgcgtgctgcaggagctgcaggagcgaccgagccagcggcatcagatgctgtacctgcggcagaaagacgctaatgaactgaagacgatccttcgagagctaaagtacagaattggcatccagtcggccaagttacttcggcatctgaagcagaaagataggcttctgcataaagtgcagaggaactgtgatattgtgactgcctgcttgcaggctgtgtcacagaagagaagagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtca

SEQ ID NO: 8375 - DNA, 978 bp, Artificial Sequence
  Description of Artificial Sequence: Synthetic polynucleotide
atggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctggtgtggttccagaaccgacgggc

SEQ ID NO: 8376 - DNA, 771 bp, Artificial Sequence
  Description of Artificial Sequence: Synthetic polynucleotide
atggcggcggcggcgggcgcccctccgccgggtcccccgcaaccgcctccgccgccgccgcccgaggagtcgtccgacagcgagcccgaggcggagcccggctccccacagaagctcatccgcaaggtgtccacgtcgggtcagatccgacagaagaccatcatcaaagaggggatgctgaccaaacagaacaattcattccagcgatcaaaaaggagatactttaagcttcgagggcgaacgctttactatgccaaaacggcaaagtcaatcatatttgatgaggtggatctgacagatgccagcgtagctgaatccagtaccaaaaacgtcaacaacagttttacggttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgag

SEQ ID NO: 8377 - protein, 1017 aa, Artificial Sequence; identical to SEQ ID NO: 11
  Description of Artificial Sequence: Synthetic polypeptide

SEQ ID NO: 8378 - protein, 528 aa, Artificial Sequence
  Description of Artificial Sequence: Synthetic polypeptide
MGETMSKRLKLHLGGEAEMEERAFVNPFPDYEAAAGALLASGAAEETGCVRPPATTDEPGLPFHQDGKIIHNFIRRIQTKIKDLLQQMEEGLKTADPHDCSAYTGWTGIALLYLQLYRVTCDQTYLLRSLDYVKRTLRNLNGRRVTFLCGDAGPLAVGAVIYHKLRSDCESQECVTKLLQLQRSVVCQESDLPDELLYGRAGYLYALLYLNTEIGPGTVCESAIKEVVNAIIESGKTLSREERKTERCPLLYQWHRKQYVGAAHGMAGIYYMLMQPAAKVDQETLTEMVKPSIDYVRHKKFRSGNYPSSLSNETDRLVHWCHGAPGVIHMLMQAYKGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 8379 - protein, 1041 aa, Artificial Sequence; identical to SEQ ID NO: 5
  Description of Artificial Sequence: Synthetic polypeptide

SEQ ID NO: 8380 - protein, 951 aa, Artificial Sequence
  Description of Artificial Sequence: Synthetic polypeptide
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 8381 - protein, 528 aa, Artificial Sequence; identical to SEQ ID NO: 8378
  Description of Artificial Sequence: Synthetic polypeptide

SEQ ID NO: 8382 - protein, 1041 aa, Artificial Sequence; identical to SEQ ID NO: 5
  Description of Artificial Sequence: Synthetic polypeptide

SEQ ID NO: 8383 - protein, 1050 aa, Artificial Sequence
  Description of Artificial Sequence: Synthetic polypeptide
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 8384 - protein, 1232 aa, Artificial Sequence
  Description of Artificial Sequence: Synthetic polypeptide
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 8385 - protein, 1041 aa, Artificial Sequence; identical to SEQ ID NO: 5
  Description of Artificial Sequence: Synthetic polypeptide

SEQ ID NO: 8386 - protein, 1041 aa, Artificial Sequence; identical to SEQ ID NO: 5
  Description of Artificial Sequence: Synthetic polypeptide

SEQ ID NO: 8387 - protein, 355 aa, Artificial Sequence
  Description of Artificial Sequence: Synthetic polypeptide
MFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEYPYVKLLLDAMKHSGCAVNKDRHFSCEDCNGNVSGGFDASTSQIVLCQNNIHNQAHMNRVVTHELIHAFDHCRAHVDWFTNIRHLACSEVRAANLSGDCSLVNEIFRLHFGLKQHHQTCVRDRATLSILAVRNISKEVAKKAVDEVFESCFNDHEPFGRIPHNKTYARYAHRDFENRDRYYSNI

SEQ ID NO: 8388 - protein, 986 aa, Artificial Sequence
  Description of Artificial Sequence: Synthetic polypeptide
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 8389 - protein, 365 aa, Artificial Sequence
  Description of Artificial Sequence: Synthetic polypeptide
MHGGGPPSGDSACPLRTIKRVQFGVLSPDELVPVLRMVEGDTIYDYCWYSLMSSAQPDTSYVASSSRENPIHIWDAFTGELRASFRAYNHLDELTAAHSLCFSPDGSQLFCGFNRTVRVFSTARPGRDCEVRATFAKKQGQSGIISCIAFSPAQPLYACGSYGRSLGLYAWDDGSPLALLGGHQGGITHLCFHPDGNRFFSGARKDAELLCWDLRQSGYPLWSLGREVTTNQRIYFDLDPTGQFLVSGSTSGAVSVWDTDGPGNDGKPEPVLSFLPQKDCTNGVSLHPSLPLLATASGQRVFPEPTESGDEGEELGLPLLSTRHVHLECRLQLWWCGGAPDSSIPDDHQGEKGQGGTEGGVGELI

SEQ ID NO: 8390 - protein, 1041 aa, Artificial Sequence; identical to SEQ ID NO: 5
  Description of Artificial Sequence: Synthetic polypeptide

SEQ ID NO: 8391 - protein, 155 aa, Artificial Sequence
  Description of Artificial Sequence: Synthetic polypeptide
MADFDTYDDRAYSSFGGGRGSRGSAGGHGSRSQKELPTEPPYTAYVGNLPFNTVQGDIDAIFKDLSIRSVRLVRDKDTDKFKGFCYVEFDEVDSLKEALTYDGALLGDRSLRVDIAEGRKQDKGGFGFRKGGPDDREIKETDGSSQIKQEPDPTW

SEQ ID NO: 8392 - protein, 228 aa, Artificial Sequence
  Description of Artificial Sequence: Synthetic polypeptide
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 8393 - protein, 328 aa, Artificial Sequence
  Description of Artificial Sequence: Synthetic polypeptide
MATEGGGKEMNEIKTQFTTREGLYKLLPHSEYSRPNRVPFNSQGSNPVRVSFVNLNDQSGNGDRLCFNVGRELYFYIYKGVRKEIDPSLGVAELPDEFFEEDNMLSMGKKMMQEAMSAFPGIDEAMSYAEVMRLVKGMNFSVVVFDTAPTGHTLRLLNFPTIVERGLGRLMQIKNQISPFISQMCNMLGLGDMNADQLASKLEETLPVIRSVSEQFKDPEQTTFICVCIAEFLSLYETERLIQELAKCKIDTHNIIVNQLVFPDPEKPCKMCEARHKIQAKYLDQMEDLYEDFHIVKLPLLPHEVRGADKVNTFSALLLEPYKPPSAQ

SEQ ID NO: 8394 - protein, 331 aa, Artificial Sequence
  Description of Artificial Sequence: Synthetic polypeptide
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKALSLCNYFESQNVDFRGKKVIELGAGTGIVGILAALQGGDVTITDLPLALEQIQGNVQANVPAGGQAQVRALSWGIDHHVFPANYDLVLGADIVYLEPTFPLLLGTLQHLCRPHGTIYLASKMRKEHGTESFFQHLLPQHFQLELAQRDEDENVNIYRARHREPRPA

SEQ ID NO: 8395 - protein, 1255 aa, Artificial Sequence
  Description of Artificial Sequence: Synthetic polypeptide
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 8396 - protein, 906 aa, Artificial Sequence
  Description of Artificial Sequence: Synthetic polypeptide
MDQVMQFVEPSRQFVKDSIRLVKRCTKPDRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 8397 - protein, 297 aa, Artificial Sequence
  Description of Artificial Sequence: Synthetic polypeptide
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEELLDKYLIANATNPESKVFYLKMKGDYFRYLAEVACGDDRKQTIDNSQGAYQEAFDISKKEMQPTHPIRLGLALNFSVFYYEILNNPELACTLAKTAFDEAIAELDTLNEDSYKDSTLIMQLLRDNLTLWTSDSAGEECDAAEGAEN

SEQ ID NO: 8398 - protein, 254 aa, Artificial Sequence
  Description of Artificial Sequence: Synthetic polypeptide
MEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQQDQTTVSSVPTTLTAPTASRPARQESWEKTTPWSGSTQTPAMCATCAIQTAPTDALGQVLKAVQRMGLRSRPSPLGWWGPSSCCWWWPWGSASSCEGATSFGSARCGGCCRRGRYRFDPRLMFSNRGSVRTRRFSKHLL

SEQ ID NO: 8399 - protein, 281 aa, Artificial Sequence
  Description of Artificial Sequence: Synthetic polypeptide
MADPGPDPESESESVFPREVGLFADSYSEKSQFCFCGHVLTITQNFGSRLGVAARVWDAALSLCNYFESQNVDFRGKKVIELGAGTGIVGILAALQVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 8400 - protein, 245 aa, Artificial Sequence
  Description of Artificial Sequence: Synthetic polypeptide
MVPAAGRRPPRVMRLLGWWQVLLWVLGLPVRGVEGYNVSLLYDLENLPASKDSIVHQAGMLKRNCFASVFEKYFQFQEEGKEGENRAVIHYRDDETMYVESKKDRVTVVFSTVFKDDDDVVIGKVFMQEFKEGRRASHTAPQVLFSHREPPLELKDTDAAVGDNIGYITFVLFPRHTNASARDNTINLIHTFRDYLHYHIKCSKAYIHTRMRAKTSDFLKVLNRARPDAEKKEMKTITGKTFSSR

SEQ ID NO: 8401 - protein, 407 aa, Artificial Sequence
  Description of Artificial Sequence: Synthetic polypeptide
MDGFAGSLGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 8402 - protein, 102 aa, Artificial Sequence
  Description of Artificial Sequence: Synthetic polypeptide
MSGQLERCEREWHELEGEFQELQDMKNATLSLNSNDSEPKYYPIAVLLKNQNQELPEDVNPAKKENYLSEQDFVSVFGITRGQFAALPGWKQLQMKKEKGLF

SEQ ID NO: 8403 - protein, 1262 aa, Artificial Sequence
  Description of Artificial Sequence: Synthetic polypeptide
MGGPQDKDERTIALVRPWPWGHQALDPAYGLDTMHPSRRSLPFPLNCQLARVGTADYGSPSDQSDQQLDCALDLMRRLPPQQIEKNLSDLIDLDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKQTTPTVGGIDTGSLEPCVCEKVPTSNTEGGWSCSLAEYIRHNDMPIYEAADKALKTFQEEFMPVETFSEFLDVAGLLSEITDPESFLKDLLNSVP

SEQ ID NO: 8404 - protein, 848 aa, Artificial Sequence
  Description of Artificial Sequence: Synthetic polypeptide
MNGQLDLSGKLIIKAQLGEDIRRIPIHNEDITYDELVLMMQRVFRGKLLSNDEVTIKYKDEDGDLITIFDSSDLSFAIQCSRILKLTLFGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVKDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 8405 - protein, 110 aa, Artificial Sequence
  Description of Artificial Sequence: Synthetic polypeptide
MAPARLFALLLFFVGGVAESDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 8406 - protein, 1121 aa, Artificial Sequence
  Description of Artificial Sequence: Synthetic polypeptide
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 8407 - protein, 188 aa, Artificial Sequence
  Description of Artificial Sequence: Synthetic polypeptide
MSVDMNSQGSDSNEEDYDPNCEEEEEEEEDDPGDIEDYYVGVASDVEQQGADAFDPEEYQFTCLTYKESEGALNEHMTSLASVLKDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 8408 - protein, 926 aa, Artificial Sequence
  Description of Artificial Sequence: Synthetic polypeptide
MSRGAGALQRRTTTYLISLTLVKLESVPPPPPSPSAAAAGAAGARGSETGDPGSPRGAEEPGKKRHERLFHRQDALWISTSSAGTGGAEPPALSPAPASPARPVSPAPGRRLSLWAVPPGPPLSGGLSPDPKPGGAPTSSRRPLLSSPSWGGPEPEGRAGGGIPGSSSPHPGTGSRRLKVAPPPPAPKPCKTVTTSGAKAGGGKGAGSRLSWPESEGKPRVKGSKSSAGTGASVSAAATAAAAGGGGSTASTSGGVGAGAGARGKLSPRKGKSKTLDNSDLHPGPPAGSPPPLTLPPTPSPATAVTAASAQPPGPAPPITLEPPAPGLKRGREGGRASTRDRKMLKFISGIFTKSTGGPPGSGPLPGPPSLSSGSGSRELLGAELRASPKAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEDEGYSFSSVLYYGNEATLLIFDLLFFCVVDLACQNFILASFLTYLQQEIFRYIRNTVGQKNLASKTLVDQRFLI

SEQ ID NO: 8409 - protein, 95 aa, Artificial Sequence
  Description of Artificial Sequence: Synthetic polypeptide
MTHFNKGPSYGLSAEVKNKVLCNGPGTCVPICVSALLLGILGIKKVIIVYVESICRVETLSMSGKILFHLSDYFIVQWPALKEKYPKSVYLGRIV

SEQ ID NO: 8410 - protein, 65 aa, Artificial Sequence
  Description of Artificial Sequence: Synthetic polypeptide
MRRQPAKVAALLLGLLLEHIEGDDLHIQRNVQKLKDTVKKLGESGEIKAIGELDLLFMSLRNACI

SEQ ID NO: 8411 - protein, 340 aa, Artificial Sequence
  Description of Artificial Sequence: Synthetic polypeptide
MRPSGTAGAALLALLAALCPASRALEEKKADIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 8412 - protein, 612 aa, Artificial Sequence
  Description of Artificial Sequence: Synthetic polypeptide
MTDGKLSTSTNGVAFMGILDGRPGNPLQNLQHVNLKAPRLLSAPEYGPKLKLRALEDRHSLQSVDSGIPTLEIGNPEPVPCSAVHVRRKQSDSDLIPERAFQSACALPSCAPPAPSSTEREQSVRKSSTFPRTGYDSVKLYSPTSKALTRSDDVSVCSVSSLGTELSTTLSVSNEDILDLVVTSSSSAIVTLENDDDPQFTNVTLSSIKETRGLHQQDCVHEAEEGSKLKILGPFSNFFARNLLARKQSARLDKHNDLGWKLFGKAPLRENAQKDSKRIQKEYEDKAGRPSKPPSPKQNVRKNLDFEPLSTTALILEDRPAHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 8413 - protein, 1775 aa, Artificial Sequence
  Description of Artificial Sequence: Synthetic polypeptide
MRLLPRLLLLLLLVFPATVLFRGGPRGLLAVAQDLTEDEETVEDSIIEDEDDEAEVEEDEPTDLHTVREETMMVMTEDMPLEISYVPSTYLTEITHVSQALLEVEQLLNAPDLCAKDFEDLFKQEESLKNIKDSLQQSSGRIDIIHSKKTAALQSATPVERVKLQEALSQLDFQWEKVNKMYKDRQGRFDRSVEKWRRFHYDIKIFNQWLTEAEQFLRKTQIPENWEHAKYKWYLKELQDGIGQRQTVVRTLNATGEEIIQQSSKTDASILQEKLGSLNLRWQEVCKQLSDRKKRLEEQKNILSEFQRDLNEFVLWLEEADNIASIPLEPGKEQQLKEKLEQVKLLVEELPLRQGILKQLNETGGPVLVSAPISPEEQDKLENKLKQTNLQWIKVSRALPEKQGEIEAQIKDLGQLEKKLEDLEEQLNHLLLWLSPIRNQLEIYNQPNQEGPFDVKETEIAVQAKQPDVEEILSKGQHLYKEKPATQPVKRKLEDLSSEWKAVNRLLQELRAKQPDLAPGLTTIGASPTQTVTLVTQPVVTKETAISKLEMPSSLMLEVPALADFNRAWTELTDWLSLLDQVIKSQRVMVGDLEDINEMIIKQKATMQDLEQRRPQLEELITAAQNLKNKTSNQEARTIITDRIERIQNQWDEVQEHLQNRRQQLNEMLKDSTQWLEAKEEAEQVLGQARAKLESWKEGPYTVDAIQKKITETKQLAKDLRQWQTNVDVANDLALKLLRDYSADDTRKVHMITENINASWRSIHKRVSEREAALEETHRLLQQFPLDLEKFLAWLTEAETTANVLQDATRKERLLEDSKGVKELMKQWQDLQGEIEAHTDVYHNLDENSQKILRSLEGSDDAVLLQRRLDNMNFKWSELRKKSLNIRSHLEASSDQWKRLHLSLQELLVWLQLKDDELSRQAPIGGDFPAVQKQNDVHRAFKRELKTKEPVIMSTLETVRIFLTEQPLEGLEKLYQEPRELPPEERAQNVTRLLRKQAEEVNTEWEKLNLHSADWQRKIDETLERLRELQEATDELDLKLRQAEVIKGSWQPVGDLLIDSLQDHLEKVKALRGEIAPLKENVSHVNDLARQLTTLGIQLSPYNLSTLEDLNTRWKLLQVAVEDRVRQLHEAHRDFGPASQHFLSTSVQGPWERAISPNKVPYYINHETQTTCWDHPKMTELYQSLADLNNVRFSAYRTAMKLRRLQKALCLDLLSLSAACDALDQHNLKQNDQPMDILQIINCLTTIYDRLEQEHNNLVNVPLCVDMCLNWLLNVYDTGRTGRIRVLSFKTGIISLCKAHLEDKYRYLFKQVASSTGFCDQRRLGLLLHDSIQIPRQLGEVASFGGSNIEPSVRSCFQFANNKPEIEAALFLDWMRLEPQSMVWLPVLHRVAAAETAKHQAKCNICKECPIIGFRYRSLKHFNYDICQSCFFSGRVAKGHKMHYPMVEYCTPTTSGEDVRDFAKVLKNKFRTKRYFAKHPRMGYLPVQTVLEGDNMETPVTLINFWPVDSAPASSPQLSHDDTHSRIEHYASRLAEMENSNGSYLNDSISPNESIDDEHLLIQHYCQSLNQDSPLSQPRSPAQILISLESEERGELERILADLEEENRNLQAEYDRLKQQHEHKGLSPLPSPPEMMPTSPQSPRDAELIAEAKLLRQHKGRLEARMQILEDHNKQLESQLHRLRQLLEQPQAEAKVNGTTVSSPSTSLQRSDSSQPMLLRVVGSQTSDSMGEEDLLSPPQDTSTGLEEVMEQLNNSFPSSRGRNTPGKPMREDTM

SEQ ID NO: 8414 - protein, 735 aa, Artificial Sequence
  Description of Artificial Sequence: Synthetic polypeptide
MPLLGQTVRSASARTRRWSRRAAGDRPGAPSEARRPQLRGDHGIVDRVRGHWRIAGSCSTCWCPSALCSSTNGFMCTFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 8415 - protein, 1017 aa, Artificial Sequence
  Description of Artificial Sequence: Synthetic polypeptide
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQEEQNRGKPNWEHLNEDLHVLITVEDAQNRAEIKLKRAVEEVKKLLVPAAEGEDSLKKMQLMELAILNGTYRDANIKSPALAFSLAATAQAAPRIITGPAPVLPPAALRTPTPAGPTIMPLIRQIQTAVMPNGTPHPTAAIVPPGPEAGLIYTPYEYPYTLAPATSILEYPIEPSGVLGAVATKVRRHDMRVHPYQRIVTADRAATGN

SEQ ID NO: 8416 - protein, 160 aa, Artificial Sequence
  Description of Artificial Sequence: Synthetic polypeptide
MADIEQYYMKPPEIVKEAEVPQAALGVPAQGTGDNGHTPVEEEVGGIPVPAPGLLQVTERRQPLSSVSSLEVHFDLLDLTELTDMSDQELAEVFADSDDENLNTESPAGLHPLPRAGYLRSPSWTRTRAEQSHEKQPLGDPERQATVLDTFLTVERPQED

SEQ ID NO: 8417 - protein, 1428 aa, Artificial Sequence
  Description of Artificial Sequence: Synthetic polypeptide
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 8418 - protein, 1017 aa, Artificial Sequence; identical to SEQ ID NO: 11
  Description of Artificial Sequence: Synthetic polypeptide

SEQ ID NO: 8419 - protein, 502 aa, Artificial Sequence
  Description of Artificial Sequence: Synthetic polypeptide
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQVHLGSGIWVDEEKWHQLQVTQGDSKYTKNLAVMIWGTDVLKNRSVTGVATKKKKDAVPKPPLSPHKLSIVRECLYDRIAQETVDETEIAQRLSKVNKYICEKIMDINKSCKNEERREAKYNLQ

SEQ ID NO: 8420 - protein, 773 aa, Artificial Sequence
  Description of Artificial Sequence: Synthetic polypeptide
MLLSLPALHLQTSEHHPFFQLPHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKSGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 8421 - protein, 1428 aa, Artificial Sequence; identical to SEQ ID NO: 8417
  Description of Artificial Sequence: Synthetic polypeptide

SEQ ID NO: 8422 - protein, 279 aa, Artificial Sequence
  Description of Artificial Sequence: Synthetic polypeptide
MAELDPFGAPAGAPGGPALGNGVAGAGEEDPAAAFLAQQESEIAGIENDEAFAILDGGAPGPQPHGEPPGGPDAVDGVMNGEYYQESNGPTDSYAAISQVDRLQSEPESIRKWREEQMERLEALDANSRKQEAEWKEKAIKELEEWYARQDEQLQKTKANNRTILLSVISLLNEPNTFSPANVDASVMFRKWRDSKGKDKEYAEIIRKQVSATKAEAEKDGVKVPTTLAEYCIKTKVPSNDNSSDLLYDDLYDDDIDDEDEEEEDADCYDDDDSGNEES

SEQ ID NO: 8423 - protein, 186 aa, Artificial Sequence
  Description of Artificial Sequence: Synthetic polypeptide
MSRPVRFMERNPLTNAIIRTTTALTIFKAGVKFNVIPPVAQATVNFRIHPGQTVQEVLELTKNIVADNRVQFHVLSAFDPLPVSPSDDKALGYQLLRQTVQSVFPEVNITAPVTSIGNTDSRFFTNLTTGIYRFYPIYIQPEDFKRIHGVNEKISVQAYETQVKFIFELIQNADTDQEPVSHLHKL

SEQ ID NO: 8424 - protein, 940 aa, Artificial Sequence
  Description of Artificial Sequence: Synthetic polypeptide
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAARNLSMPDLENRLIELHSPDSRNTLILRCKDTATAHSWFVAIHTNIMALLPQVLAELNAMLGATSTAGGSKEVKHIAWLAEQAKLDGGRQQWRPVLMAVTEKDLLLYDCMPWTRDAWASPCHSYPLVATRLVHSGSGCRSPSLGSDLTFATRTGSRQGIEMHLFRVETHRDLSSWTRILVQGCHAAAELIKEVSLGCMLNGQEVRLTIHYENGFTISRENGGSSSILYRYPFERLKMSADDGIRNLYLDFGGPEGELKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQMQGVGNNNDGTLVLGATNIPWVLDSAIRRRFEKRIYIPLPEEAARAQMFRLHLGSTPHNLTDANIHELARKTEGYSGADISIIVRDSLMQPVRKVQSATHFKKVCGPSRTNPSMMIDDLLTPCSPGDPGAMEMTWMDVPGDKLLEPVVCMSDMLRSLATTRPTVNADDLLKVKKFSEDFGQES

SEQ ID NO: 8425 - protein, 396 aa, Artificial Sequence
  Description of Artificial Sequence: Synthetic polypeptide
MKTPADTGDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 8426 - protein, 1044 aa, Artificial Sequence
  Description of Artificial Sequence: Synthetic polypeptide
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 8427 - protein, 683 aa, Artificial Sequence
  Description of Artificial Sequence: Synthetic polypeptide
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLAESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 8428 - protein, 2135 aa, Artificial Sequence
  Description of Artificial Sequence: Synthetic polypeptide
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVTSDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDFSPGAGGFCTTLPPSFLRVDDRATSSTTDSSRAPSSPRPPGSTSHCGISTRCTERCLCVLPLRTSQVPDVMAPQHDQEKFHDLAYSCLGKSFSMSNQDLYGYSTSSLALGLAWLSWETKKKNVLHLVGLDSL

SEQ ID NO: 8429 - protein, 511 aa, Artificial Sequence
  Description of Artificial Sequence: Synthetic polypeptide
MSGGKKKSSFQITSVTTDYEGPGSPGASDPPTPQPPTGPPPRLPNGEPSPDPGGKGTPRNGSPPPGAPSSRFRVVKLPHGLGEPYRRGRWTCVDVYERDLEPHSFGGLLEGIRGASGGAGGRSLDSRLELASLGLGAPTPPSGLSQGPTSWLRPPPTSPGPQARSFTGGLGQLVVPSKAKAEKPPLSASSPQQRPPEPETGESAGTSRAATPLPSLRVEAEAGGSGARTPPLSRRKAVDMRLRMELGAPEEMGQVPPLDSRPSSPALYFTHDASLVHKSPDPFGAVAAQKFSLAHSMLAISGHLDSDDDSGSGSLVGIDNKIEQAMVFFWRQKIKPTISGHPDSKKHSLKKMEKTLQVVETLRLVELPKEAKPKLGESPELADPCVLAKTTEETEVELGQQGQSLLQLPRTAVKSVSTLMVSALQSGWQMCSWKSSVSSASVSSQVRTQSPLKTPEAELLWEVYLVLWAVRKHLRRLYRRQERHRRHHVRCHAAPRPNPAQSLKLDAQSPL

SEQ ID NO: 8430 - protein, 611 aa, Artificial Sequence
  Description of Artificial Sequence: Synthetic polypeptide
MALRRLGAALLLLPLLAAVEGAGQDVGRSCILVSIAGKNVMLDCGMHMGFNDDRRFPDFSYITQNGRLTDFLDCVIISHFHLDHCGALPYFSEMVGYDGPIYMTHPTQAICPILLEDYRKIAVDKKGEANFFTSQMIKDCMKKVVAVHLHQTVQVDDELEIKAYYAGHVLGAAMFQIKVGSESVVYTGDYNMTPDRHLGAAWIDKCRPNLLITESTYATTIRDSKRCRERDFLKKVHETVERGGKVLIPVFALGRAQELCILLETFWERMNLKVPIYFSTGLTEKANHYYKLFIPWTNQKIRKTFVQRNMFEFKHIKAFDRAFADNPGPMVVFATPGMLHAGQSLQIFRKWAGNEKNMVIMPGYCVQGTVGHKILSGQRKLEMEGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPEAKKPRLLHGTLIMKDSNFRLVSSEQALKELGLAEHQLRFTCRVHLHDTRKEQETALRVYSHLKSVLKDHCVQHLPDGSVTVESVLLQAAAPSEDPGTKVLLVSWTYQDEELGSFLTSLLKKGLPQAPS

SEQ ID NO: 8431 - protein, 265 aa, Artificial Sequence
  Description of Artificial Sequence: Synthetic polypeptide
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVWKHMLL

SEQ ID NO: 8432 - protein, 1033 aa, Artificial Sequence
  Description of Artificial Sequence: Synthetic polypeptide
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 8433 - protein, 861 aa, Artificial Sequence
  Description of Artificial Sequence: Synthetic polypeptide
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 8434 - protein, 1036 aa, Artificial Sequence
  Description of Artificial Sequence: Synthetic polypeptide
MEARSMLVPPQASVCFEDVAMAFTQEEWEQLDLAQRTLYREVTLETWEHIVSLGLFLSKSDVISQLEQEEDLCRAEQEAPRGKSKEAEIKRINKELANIRSKFKGDKALDGYSKKKYVCKLLFIFLLGHDIDFGHMEAVNLLSSNKYTEKQIGYLFISVLVNSNSELIRLINNAIKNDLASRNPTFMCLALHCIANVGSREMGEAFAADIPRILVAGDSMDSVKQSAALCLLRLYKASPDLVPMGEWTARVVHLLNDQHMGVVTAAVSLITCLCKKNPDDFKTCVSLAVSRLSRIVSSASTDLQDYTYYFVPAPWLSVKLLRLLQCYPPPEDAAVKGRLVECLETVLNKAQEPPKSKKVQHSNAKNAILFETISLIIHYDSEPNLLVRACNQLGQFLQHRETNLRYLALESMCTLASSEFSHEAVKTHIDTVINALKTERDVSVRQRAADLLYAMCDRSNAKQIVSEMLRYLETADYAIREEIVLKVAILAEKYAVDYSWYVDTILNLIRIAGDYVSEEVWYRVLQIVTNRDDVQGYAAKTVFEALQAPACHENMVKVGGYILGEFGNLIAGDPRSSPPVQFSLLHSKFHLCSVATRALLLSTYIKFINLFPETKATIQGVLRAGSQLRNADVELQQRAVEYLTLSSVASTDVLATVLEEMPPFPERESSILAKLKRKKGPGAGSALDDGRRDPSSNDINGGMEPTPSTVSTPSPSADLLGLRAAPPPAAPPASAGAGNLLVDVFDGPAAQPSLGPTPEEAFLSELEPPAPESPMALLADPAPAADPGPEDIGPPIPEADELLNKFVCKNNGVLFENQLLQIGVKSEFRQNLGRMYLFYGNKTSVQFQNFSPTVVHPGDLQTHLAVQTKRVAAQVDGGAQVQQVLNIECLRDFLTPPLLSVRFRYGGAPQALTLKLPVTINKFFQPTEMAAQDFFQRWKQLSLPQQEAQKIFKANHPMDAEVTKAKLLGFGSALLDNVDPNPENFVGAGIIQTKALQVGCLLRLEPNAQAQMYRLTLRTSKEPVSRHLCELLAQQF

SEQ ID NO: 8435 - protein, 562 aa, Artificial Sequence
  Description of Artificial Sequence: Synthetic polypeptide
MASESGKLWGGRFVGAVDPIMEKFNASIAYDRHLWEVDVQGSKAYSRGLEKAGLLTKAEMDQILHGLDKVAEEWAQGTFKLNSNDEDIHTANERRLKELIGATAGKLHTGRSRNDQVVTDLRLWMRQTCSTLSGLLWELIRTMVDRAEAERDVLFPGYTHLQRAQPIRWSHWILSHAVALTRDSERLLEVRKRINVLPLGSGAIAGNPLGVDRELLRAELNFGAITLNSMDATSERDFVAEFLFWASLCMTHLSRMAEDLILYCTKEFSFVQLSDAYSTGSSLMPQKKNPDSLELIRSKAGRVFGRCAGLLMTLKGLPSTYNKDLQEDKEAVFEVSDTMSAVLQVATGVISTLQIHQENMGQALSPDMLATDLAYYLVRKGMPFRQAHEASGKAVFMAETKGVALNQLSLQELQTIRKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 8436 - protein, 1017 aa, Artificial Sequence; identical to SEQ ID NO: 11
  Description of Artificial Sequence: Synthetic polypeptide

SEQ ID NO: 8437 - protein, 482 aa, Artificial Sequence
  Description of Artificial Sequence: Synthetic polypeptide
MGETMSKRLKLHLGGEAEMEERAFVNPFPDYEAAAGALLASGAAEETGCVRPPATTDEPGLPFHQDGKQKENNIRCLTTIGHFGFECLPNQLVSRSIRQGFTFNILCVGETGIGKSTLIDTLFNTNLKDNKSSHFYSNVGLQIQTYELQESNVQLKLTVVETVGYGDQIDKEASYQPIVDYIDAQFEAYLQEELKIKRSLFEYHDSRVHVCLYFISPTGHSLKSLDLLTMKNLDSKVNIIPLIAKADTISKNDLQTFKNKIMSELISNGIQIYQLPTDEETAAQANSSVSGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 8438 - protein, 190 aa, Artificial Sequence
  Description of Artificial Sequence: Synthetic polypeptide
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKDITSAVQSKRRKSK

SEQ ID NO: 8439 - protein, 1136 aa, Artificial Sequence
  Description of Artificial Sequence: Synthetic polypeptide
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQCTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 8440 - protein, 513 aa, Artificial Sequence
  Description of Artificial Sequence: Synthetic polypeptide
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTADKCSPNYLGSDWYNTWRMEPYNSSCCNKYTTYLPRLPKEARMETAVRGMPLECPPRPERLNAYEREVMVNMLNSLSRNQQLPRITPRCGCVDPLPGRLPFHGYESACSGRHYCLRGMDYYASGAPCTDRRLRPWCREQPTMCTSLRAPARNAVCCYNSPAVILPISEP

SEQ ID NO: 8441 - protein, 1058 aa, Artificial Sequence
  Description of Artificial Sequence: Synthetic polypeptide
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVSTRGDNEKVQRELSHLQSENDAAKDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDADEVKKALELQMESHREAHHRQLARLRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 8442 - protein, 376 aa, Artificial Sequence
  Description of Artificial Sequence: Synthetic polypeptide
MKLADSVMAGKASDGSIKWQLCYDISARTWWMDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAVISECQRQQLEAVSYSSRYALGLFYEAGTKIDVPWAGQYITSNPCIRFVSIDNKKRNIESSEIGPSLVIHTTVPFGVTYLEHSIEDVQELVFQQLENILPGLPQPIATKCQKWRHSQVTNAAANCPGQMTLHHKPFLACGGDGFTQSNFDGCITSALCVLEALKNYI

SEQ ID NO: 8443 - protein, 494 aa, Artificial Sequence
  Description of Artificial Sequence: Synthetic polypeptide
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENEGIVSPSDLDLVMSEGLGMRYAFIGPLETMHLNAEGMLSYCDRYSEGIKHVLQTFGPIPEFSRATAEKVNQDMCMKVPDDPEHLAARRQWRDECLMRLAKLKSQVQPQ

SEQ ID NO: 8444 - protein, 614 aa, Artificial Sequence
  Description of Artificial Sequence: Synthetic polypeptide
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNTRHYVGSAAAFAGTPEHGQFQGSPGGAYGTAQPPPHYGPTQPAYSPSQQLRAPSAFPAVQYLSQPQPQPYAVHGHFQPTQTGFLQPGGALSLQKQMEHANQQTGFSDSSSLRPMHPQALHPAPGLLASPQLPVQMQPAGKSGFAATSQPGPRLPFIQHSQNPRFYHK

SEQ ID NO: 8445 - protein, 306 aa, Artificial Sequence
  Description of Artificial Sequence: Synthetic polypeptide
MVNLAAMVWRRLLRKRWVLALVFGLSLVYFLSSTFKQDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 8446 - protein, 536 aa, Artificial Sequence
  Description of Artificial Sequence: Synthetic polypeptide
MDAPRASAAKPPTGRKMKARAPPPPGKAATLHVHSDQKPPHDGALGSQQNLVRMKEALRASTMDVTVVLPSGLEKRSVLNGSHAMMDLLVELCLQNHLNPSHHALEIRSSETQQPLSFKPNTLIGTLNVHTVFLKEKVPEEKVKPGPPKVPEKSVRLVVNYLRTQKAVVRVSPEVPLQNILPVICAKCEVSPEHVVLLRDNIAGEELELSKSLNELGIKELYAWDNRRETFRKSSLGNDETDKEKKKFLGFFKVNKRSNSKAEQLVLSGADSDEDTSRAAPGRGLNGCLTTPNSPSMHSRSLTLGPSLSLGSISGVSVKSEMKKRRAPPPPGSGPPVQDKASEKGLLPFAVVGSTDEVKVGKRMVRGRHYPWGVLQVENENHCDFVKLRDMLLCTNMENLKEKTHTQHYECYRYQKLQKMGFTDVGPNNQPVSFQEIFEAKRQEFYDQCQREEEELKQRFMQRVKEKEATFKEAEKELQDKFEHLKMIQQEEIRKLEEEKKQLEGEIIDFYKMKAASEALQTQLSTDTKKDKHRKK

SEQ ID NO: 8447 - protein, 196 aa, Artificial Sequence
  Description of Artificial Sequence: Synthetic polypeptide
MKLALLLPWACCCLCGSALATGFLYPFSAAALQQHGYPEPGAGSPGSGYASRRHWCHHTVTRTVSCQVQNGSETVVQRVYQSCRWPGPCANLVSYRTLIRPTYRVSYRTVTVLEWRCCPGFTGSNCDEECMNCTRLSDMSERLTTLEAKIICMGAKENGLPLEYQEKLKAIEPNDYTGKVSEEIEDIIKKGETQTL

SEQ ID NO: 8448 - protein, 813 aa, Artificial Sequence
  Description of Artificial Sequence: Synthetic polypeptide
MAAETQTLNFGPEWLRALSSGGSITSPPLSPALPKYKLADYRYGREEMLALFLKDNKIPSDLLDKEFLPILQEEPLPPLALVPFTEEEQLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 8449 - protein, 1041 aa, Artificial Sequence; identical to SEQ ID NO: 5
  Description of Artificial Sequence: Synthetic polypeptide

SEQ ID NO: 8450 - protein, 877 aa, Artificial Sequence
  Description of Artificial Sequence: Synthetic polypeptide
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 8451 - protein, 192 aa, Artificial Sequence
  Description of Artificial Sequence: Synthetic polypeptide
MAEGAQPHQPPQLGPGAAARGMKRESELELPVPGAGGDGADPGLSKRPRTEEAAADGGGGMQGELEVKNMDMKPGSTLKITGSIADGTDGFVINLGQGTDKLNLHFNPRFSESTIVCNSLDGSNWGQEQREDHLCFSPGSEVKFTVTFESDKFKVKLPDGHELTFPNRLGHSHLSYLSVRGGFNMSSFKLKE

SEQ ID NO: 8452 - protein, 442 aa, Artificial Sequence
  Description of Artificial Sequence: Synthetic polypeptide
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIEEVRDAMENEMRTQLRRQAAAHTDHLRDVLRVQEQELKSEFEQNLSEKLSEQELQFRRLSQEQVDNFTLDINTAYARLRGIEQAVQSHAVAEEEARKAHQLWLSVEALKYSMKTSSAETPTIPLGSAVEAIKANCSDNEFTQALTAAIPPESLTRGVYSEETLRARFYAVQKLARRVAMIDETRNSLYQYFLSYLQSLLLFPPQQLKPPPELCPEDINTFKLLSYASYCIEHGDLELAAKFVNQLKGESRRVAQDWLKEARMTLETKQIVEILTAYASAVGIGTTQVQPE

SEQ ID NO: 8453 - protein, 276 aa, Artificial Sequence
  Description of Artificial Sequence: Synthetic polypeptide
MGVPKFYRWISERYPCLSEVVKEHQVICNSFTICNAEMQEVGVGLYPSISLLNHSCDPNCSIVFNGPHLLLRAVRDIEVGEELTICYLDMLMTSEERRKQLRDQYCFECDCFRCQTQDKDADMLTGDEQVWKEVQESLKKIEELKAHWKWEQVLAMCQAIISSNSERLPDINIYQLKVLDCAMDACINLGLLEEALFYGTRTMEPYRIFFPGSHPVRGVQVMKVGKLQLHQGMFPQAMKNLRLAFDIMRVTHGREHSLIEDLILLLEECDANIRAS

SEQ ID NO: 8454 - protein, 479 aa, Artificial Sequence
  Description of Artificial Sequence: Synthetic polypeptide
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKDPSLPNVQVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 8455 - protein, 639 aa, Artificial Sequence
  Description of Artificial Sequence: Synthetic polypeptide
MLRLQMTDGHISCTAVEFSYMSKISLNTPPGTKVKLSGIVDIKNGFLLLNDSNTTVLGGEVEHLIEKWELQRSLSKHNRSNIGTEGGPPPFVPFGQKCVSHVQVDSRELDRRKTLQVTMPVKPTNDNDEFEKQRTAAIAEVAKSKETKTFGGGGGGARSNLNMNAAGNRNREVLQKEKSTKSEGKHEGVYRELVDEKALKHITEMGFSKEASRQALMDNGNNLEAALNVLLTSNKQKPVMGPPLRGRGKGRGRIRSEDEEDLGNARPSAPSTLFDFLESKMGTLNVEEPKSQPQQLHQGQYRSSNTEQNGVKDNNHLRHPPRNDTRQPRNEKPPRFQRDSQNSKSVLEGSGLPRNRGSERPSTSSVSEVWAEDRIKCDRPYSRYDRTKDTSYPLGSQHSDGAFKKRDNSMQSRSGKGPSFAEAKENPLPQGSVDYNNQKRGKRESQTSIPDYFYDRKSQTINNEAFSGIKIEKHFNVNTDYQNPVRSNSFIGVPNGEVEMPLKGRRIGPIKPAGPVTAVPCDDKIFYNSGPKRRSGPIKPEKILESSIPMEYAKMWKPGDECFALYWEDNKFYRAEVEALHSSGMTAVVKFIDYGNYEEVLLSNIKPIQTEAWGYDHSYYFIATFITDHIRHHAKYLNA

SEQ ID NO: 8456 - protein, 1047 aa, Artificial Sequence
  Description of Artificial Sequence: Synthetic polypeptide
MADPGMMSLFGEDGNIFSEGLEGLGECGYPENPVNPMGQQMPIDQGFASLQPSLHHPSTNQNQTKLTHFDHYNQYEQQKMHLMDQPNRMMSNTPGNGLASPHSQYHTPPVPQVPHGGSGGGQMGVYPGMQNERHGQSFVDSSSMWGPRAVQVPDQIRAPYQQQQPQPQPPQPAPSGPPAQGHPQHMQQMGSYMARGDFSMQQHGQPQQRMSQFSQGQEGLNQGNPFIATSGPGHLSHVPQQSPSMAPSLRHSVQQFHHHPSTALHGESVAHSPRFSPNPPQQGAVRPQTLNFSSRSQTVPSPTINNSGQYSRYPYSNLNQGLVNNTGMNQNLGLTNNTPMNQSVPRYPNAVGFPSNSGQGLMHQQPIHPSGSLNQMNTQTMHPSQPQGTYASPPPMSPMKAMSNPAGTPPPQVRPGSAGIPMEVGSYPNMPHPQPSHQPPGAMGIGQRNMGPRNMQQSRPFIGMSSAPRELTGHMRPNGCPGVGLGDPQAIQERLIPGQQHPGQQPSFQQLPTCPPLQPHPGLHHQSSPPHPHHQPWAQLHPSPQNTPQKVPVHQFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 8457 - protein, 747 aa, Artificial Sequence
  Description of Artificial Sequence: Synthetic polypeptide
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPEYINQSVPKRPAGSVQNPVYHNQPLNPAPSRDPHYQDPHSTAVGNPEYLNTVQPTCVNSTFDSPAHWAQKGSHQISLDNPDYQQDFFPKEAKPNGIFKGSTAENAEYLRVAPQSSEFIGA

SEQ ID NO: 8458 - protein, 648 aa, Artificial Sequence
  Description of Artificial Sequence: Synthetic polypeptide
MNNLNDPPNWNIRPNSRADGGDGSRWNYALLVPMLGLAAFRVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 8459 - protein, 1938 aa, Artificial Sequence
  Description of Artificial Sequence: Synthetic polypeptide
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGESVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHSPLVDHRLYKRSERIEKGQGT

SEQ ID NO: 8460 - protein, 72 aa, Artificial Sequence
  Description of Artificial Sequence: Synthetic polypeptide
MARGYGATVSLVLLGLGLALAVIVLAVVLSRHQAPCGPQAFAHAAVAADSKVCSDIGRQETAYLLVYMKMEC

SEQ ID NO: 8461 - protein, 313 aa, Artificial Sequence
  Description of Artificial Sequence: Synthetic polypeptide
MFVYVLTPGEQSGRRLPGQTWLMFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 8462 - protein, 2826 aa, Artificial Sequence
  Description of Artificial Sequence: Synthetic polypeptide
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKAQSHSTGGSRDPAHSTFLSLDSVRSPGILIMTSSVRNFYVVGRAWIS

SEQ ID NO: 8463 - protein, 545 aa, Artificial Sequence
  Description of Artificial Sequence: Synthetic polypeptide
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 8464 - protein, 430 aa, Artificial Sequence
  Description of Artificial Sequence: Synthetic polypeptide
MENTDRKVSSLHTSRVQRQMVVSVHDLPEKSFVPLLDSKYVLCVWDIWQPSGPQKVLICESQVTCCCLSPLKAFLLFAGTAHGSVVVWDLREDSRLHYSVTLSDGFWTFRTATFSTDGILTSVNHRSPLQAVEPISTSVHKKQSFVLSPFSTQEEMSGLSFHIASLDESGVLNVWVVVELPKADIAGSISDLGLMPGGRVKLVHSALIQLGDSLSHKGNEFWGTTQTLNVKFLPSDPNHFIIGTDMGLISHGTRQDLRVAPKLFKPQQHGIRPVKVNVIDFSPFGEPIFLAGCSDGSIRLHQLSSAFPLLQWDSSTDSHAVTGLQWSPTRPAVFLVQDDTSNIYIWDLLQSDLGPVAKQQVSPNRLVAMAAVGEPEKAGGSFLALVLARASGSIDIQHLKRRWAAPEVDECNRLRLLLQEALWPEGKLHK

SEQ ID NO: 8465 - protein, 442 aa, Artificial Sequence
  Description of Artificial Sequence: Synthetic polypeptide
MTCPRNVTPNSYAEPLAAPGGGERYSRSAGMYMQSGSDFNCGVMRGCGLAPSLSKRDEGSSPSLALNTYPSYLSQLDSWGDPKAAYRLEQPVGRPLSSCSYPPSVKEENVCCMYSAEKRAKSGPEAALYSHPLPESCLGEHEVPVPSYYRASPSYSALDKTPHCSGANDFEAPFEQRASLNPRAEHLESPQLGGKVSFPETPKSDSQTPSPNEIKTEQSLAGPKGSPSESEKERAKAADSSPDTSDNEAKGKYIASTQRPDGTWRKQRRVKEGYVPQEEVPVYENKYVKFFKSKPELPPGLSPEATAPVTPSRPEGGEPGLSKTAKRNLKRKEKRRQQQEKGEAEALSRTLDKVSLEETAQLPSAPQGSRAAPTAASDQPDSAATTEKAKKIKNLKKKLRQVEELQQRIQAGEVSQPSKEQLEKLARRRALEEELEDLELGL

SEQ ID NO: 8466 - protein, 770 aa, Artificial Sequence
  Description of Artificial Sequence: Synthetic polypeptide
MAAEKQVPGGGGGGGSGGGGGSGGGGSGGGRGAGGEENKENERPSAGSKANKEFGDSLSLEILQIIKESQQQHGLRHGDFQRYRGYCSRRQRRLRKTLNFKMGNRHKFTGKKVTEELLTDNRYLLLVLMDAERAWSYAMQLKQEANTEPRKRFHLLSRLRKAVKHAEELERLCESNRVDAKTKLEAQAYTAYLSGMLRFEHQEWKAAIEAFNKCKTIYEKLASAFTEEQAVLYNQRVEEISPNIRYCAYNIGDQSAINELMQMRLRSGGTEGLLAEKLEALITQTRAKQAATMSEVEWRGRTVPVKIDKVRIFLLGLADNEAAIVQAESEETKERLFESMLSECRDAIQVVREELKPDQPLISRNYKGDVAMSKIEHFMPLLVQREEEGALAPLLSHGQVHFLWIKHSNLYLVATTSKNANASLVYSFLYKTIEVFCEYFKELEEESIRDNFVIVYELLDELMDFGFPQTTDSKILQEYITQQSNKLETGKSRVPPTVTNAVSWRSEGIKYKKNEVFIDVIESVNLLVNANGSVLLSEIVGTIKLKVFLSGMPELRLGLNDRVLFELTGLSGSKNKSVELEDVKFHQCVRLSRFDNDRTISFIPPDGDFELMSYRLSTQVKPLIWIESVIEKFSHSRVEIMVKAKGQFKKQSVANGVEISVPVPSDADSPRFKTSVGSAKYVPERNVVIWSIKSFPGGKEYLMRAHFGLPSVEKEEVEGRPPIGVKFEIPYFTVSGIQVRYMKIIEKSGYQALPWVRYITQSGDYQLRTS

SEQ ID NO: 8467 - protein, 462 aa, Artificial Sequence
  Description of Artificial Sequence: Synthetic polypeptide
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEGLIGLLQEGNTTVLVEVNCETDFVSRNLKFQLLVQQVALGTMMHCQTLKDQPSAYSKVQWLTPVNLALWEAEAGGSLEGFLNSSELSGLPAGPDREGSLKDQLALAIDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 8468 - protein, 930 aa, Artificial Sequence
  Description of Artificial Sequence: Synthetic polypeptide
MASLRRVKVLLVLNLIAVAGFVLFLAKCRPIAVRSGDAFHEIRPRAEVANLSAHSASPIQDAVLKRLSLLEDIVYRQLNGLSKSLGLIEGYGGRGKGGLPATLSPAEEEKAKGPHEKYGYNSYLSEKISLDRSIPDYRPTKFVIGREKPGQVSEVAQLISQTLEQERRQRELLEQHYAQYDADDDENTVAELQGMSGNCNNNNNYFLKTGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKVENTWITKANKRNPNPSSSSIFGRHSQLMSVVWIQETNNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 8469 - protein, 722 aa, Artificial Sequence
  Description of Artificial Sequence: Synthetic polypeptide
MQSTQAHENSRDSRLAWMGTWEHLVSTGFNQMREREVKLWDTRFFSSALASLTLDTSLGCLVPLLDPDSGLLVLAGKGERQLYCYEVVPQQPALSPVTQCVLESVLRGAALVPRQALAVMSCEVLRVLQLSDTAIVPIGYHVPRKAVEFHEDLFPDTAGCVPATDPHSWWAGDNQQVQKVSLNPACRPHPSFTSCLVPPAEPLPDTAQPAVMETPVGDADASEGFSSPPSSLTSPSTPSSLGPSLSSTSGIGTSPSLRSLQSLLGPSSKFRHAQGTVLHRDSHITNLKGLNLTTPGESDGFCANKLRVAVPLLSSGGQVAVLELRKPGRLPDTALPTLQNGAAVTDLAWDPFDPHRLAVAGEDARIRLWRVPAEGLEEVLTTPETVLTGHTEKICSLRFHPLAANVLASSSYDLTVRIWDLQAGADRLKLQGHQDQIFSLAWSPDGQQLATVCKDGRVRVYRPRSGPEPLQEGPGPKGGRGARIVWVCDGRCLLVSGFDSQSERQLLLYEAEALAGGPLAVLGLDVAPSTLLPSYDPDTGLVLLTGKGDTRVFLYELLPESPFFLECNSFTSPDPHKGLVLLPKTECDVREVELMRCLRLRQSSLEPVAFRLPRVRKEFFQDDVFPDTAVIWEPVLSAEAWLQGANGQPWLLSLQPPDMSPVSQAPREAPARRAPSSAQYLEEKSDQQKKEELLNAMVAKLGNREDPLPQDSFEGVDEDEWD

SEQ ID NO: 8470 - protein, 103 aa, Artificial Sequence
  Description of Artificial Sequence: Synthetic polypeptide
MGETMSKRLKLHLGGEAEMEERAFVNPFPDYEAAAGALLASGAAEETGCVRPPATTDEPGLPFHQDGKDAFIGFGGNVIRQQVKDNAKWYITDFVELLGELEE

SEQ ID NO: 8471 - protein, 431 aa, Artificial Sequence
  Description of Artificial Sequence: Synthetic polypeptide
MPQSKSRKIAILGYRSVASGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 8472 - protein, 396 aa, Artificial Sequence
  Description of Artificial Sequence: Synthetic polypeptide
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQGQERFGNMTRVYYREAMGAFIVFDVTRPATFEAVAKWKNDLDSKLSLPNGKPVSVVLLANKCDQGKDVLMNNGLKMDQFCKEHGFVGWFETSAKENINIDEASRCLVKHILANECDLMESIEPDVVKPHLTSTKVASCSGCAKS

SEQ ID NO: 8473 - protein, 1690 aa, Artificial Sequence
  Description of Artificial Sequence: Synthetic polypeptide
MAERGLEPSPAAVAALPPEVRAQLAELELELSEGDITQKGYEKKRSKLLSPYSPQTQETDSAVQKELRNQTPAPSAAQTSAPSKYHRTRSGGARDERYRSDIHTEAVQAALAKHKEQKMALPMPTKRRSTFVQSPADACTPPDTSSASEDEGSLRRQAALSAALQQSLQNAESWINRSIQGSSTSSSASSTLSHGEVKGTSGSLADVFANTRIENFSAPPDVTTTTSSSSSSSSIRPANIDLPPSGIVKGMHKGSNRSSLMDTADGVPVSSRVSTKIQQLLNTLKRPKRPPLKEFFVDDSEEIVEVPQPDPNQPKPEGRQMTPVKGEPLGVICNWPPALESALQRWGTTQAKCSCLTALDMTGKPVYTLTYGKLWSRSLKLAYTLLNKLGTKNEPVLKPGDRVALVYPNNDPVMFMVAFYGCLLAEVIPVPIEVPLTRKDAGGQQIGFLLGSCGIALALTSEVCLKGLPKTQNGEIVQFKGWPRLKWVVTDSKYLSKPPKDWQPHISPAGTEPAYIEYKTSKEGSVMGVTVSRLAMLSHCQALSQACNYSEGETIVNVLDFKKDAGLWHGMFANVMNKMHTISVPYSVMKTCPLSWVQRVHAHKAKVALVKCRDLHWAMMAHRDQRDVSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQNRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEETDSSEQDEQTDTENLALHISMIESRSVTQAGVQWQDLGSLQPPPPGFKRFSSLSLLSSWNYRRILEPRRRTPLSCSRTPPCRVAGMGRRTSSITLICGR

SEQ ID NO: 8474 - protein, 563 aa, Artificial Sequence
  Description of Artificial Sequence: Synthetic polypeptide
MEPPAAKRSRGCPAGPEERDAGAGAARGRGRPEALLDLSAKRVAESWAFEQVEERFSRVPEPVQKRIVFWSFPRSEREICMYSSLGYPPPEGEHDARVPFTRGLHLLQSGAVDRVLQVGFHLSGNIREPGSPGEPERLYHVSISFDRCKITSVSCGCDNRDLFYCAHVVALSLYRIRHAHQVELRLPISETLSQMNRDQLQKFVQYLISAHHTEVLPTAQRLADEILLLGSEINLVNGAPDPTAGAGIEDANCWHLDEEQIQEQVKQLLSNGGYYGASQQLRSMFSKVREMLRMRDSNGARMLILMTEQFLQDTRLALWRQQGAGMTDKCRQLWDELGMFNSPEMQALLQQISENPQLMQNVISAPYMRSMMQTLAQNPDFAAQMMVNVPLFAGNPQLQEQLRLQLPVFLQQMQNPESLSILTNPRAMQALLQIQQGLQTLQTEAPGLVPSLGSFGISRTPAPSAGSNAGSTPEAPTSSPATPATSSPTGASSAQQQLMQQMIQLLAGSGNSQVQTPEVRFQQQLEQLNSMGFINREANLQALIATGGDINAAIERLLGSQLS

SEQ ID NO: 8475 - protein, 906 aa, Artificial Sequence
  Description of Artificial Sequence: Synthetic polypeptide
MDVLPTGGGRPGLRTELEFRGGGGEARLESQEEETIPAAPPAPRLRGAAERPRRSRDTWDGDEDTEPGEACGGRTSRTASLVSGLLNELYSCTEEEEAAGGGRGAEGRRRRRDSLDSSTEASGSDVVLGGRSGAGDSRVLQELQERPSQRHQMLYLRQKDANELKTILRELKYRIGIQSAKLLRHLKQKDRLLHKVQRNCDIVTACLQAVSQKRRVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 8476 - protein, 326 aa, Artificial Sequence
  Description of Artificial Sequence: Synthetic polypeptide
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPGVVPEPTG

SEQ ID NO: 8477 - protein, 257 aa, Artificial Sequence
  Description of Artificial Sequence: Synthetic polypeptide
MAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 8478 - protein, 368 aa, Homo sapiens
  MOD_RES (221)..(226): Any amino acid
  MOD_RES (277)..(330): Any amino acid
WRRLPPCDEFVGARRSKHTVVAYKDAIYVFGGDNGKTMLNDLLRFDVKDCSWCRFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLXXXXXXPQRRYGHTMVAFDRHLYVFGGAADNTLPNELHCYDVDFQTWEVVQPSSDSXXXXXXXXXXXXXXXXXXXXXXXXXXXXXXXXXXXXXXXXXXXXXXXXXXXXXXPSGRLFHAAAVISDAMYIFGGTVDNNIRSGEMYRFQFS

SEQ ID NO: 8479 - protein, 800 aa, Homo sapiens
  MOD_RES (291)..(342): Any amino acid
LTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSXXXXXXXXXXXXXXXXXXXXXXXXXXXXXXXXXXXXXXXXXXXXXXXXXXXXELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 8480 - protein, 751 aa, Drosophila melanogaster
LNVDFTSYTATHQWTRMLECAEFVGAKRSKHTVVAYKDAMFVFGGDNGKNMLNDLIRFGVKDKSWGRACATGTPPAPRYHHSAVVAGSSMFIFGGYTGDIHSNSNLTNKNDLFEYKFQSAMWVEWKFSGRQPVPRSAHGAAVYDNKMWIYAGYDGNARLNDMWTLNLTGENQWEEVDQLGDRPPTCCNFPVAVARDAMYVFSGQSGLQITNSLFEFHFKTRTWRRISNEPVLRGATSAPPSRRYGHTMVHHDRFLYVFGGSADSTLPNDLHCYDLDSQVWSVIQPEQNSDVPSGRVFHASAVICDAMYIFGGTVDNSVRRGDTYRFQFSSYPKCTLRDDFGKFFQDKQFCDIQFIVGAEEIRILAHIAFVAARSKYLRNKILAAREARQQQMEKVYGVGQVDALALNAGAGGDRGPMLEVRLANASPEAFEIILNYIYTDRIDLKDTYSKNIIILITDIYQLAGLFTMPRLAHGCIQYLDYKINKLNVLEALYNADKSNIKIIKDHCMQFIIKEENFTDVVMSSEFSDLDKPLLVEIIRKRLYPSKLVIDTSYEGNIGTTLEIDLCAFLESTGKDFCDISLVLEDHVIPAHKSVLSSRCTYFQGMFRSFMPPDNTVNIQIGEISPSLEAFHSLLRYIYYGETKMPPQDALYLFQAPCFYGLANNRLHAFCKYSLEHNITFENVLQTLEASDITKIYDIKEYALKLIVKDFAKVARLPKIAGLSRELLLEIIRAVADSHGEFLTRININTDI

SEQ ID NO: 8481 - protein, 735 aa, Amphimedon queenslandica
TELDFSLKEPPHSWKQLQSCEEFVGAKRSKHTMVAWDDKVYVFGGDNGKRMLNDFLVSHVNDSSWARVVITGGQAPPPRYHHSAVVFRNSMFIFGGYTTGDINSNSNLRNKNDLYEYNFTTSQWIDWADKVTGPLPPARSAHGAVIYDNRLWIFAGYDGNTRLNDMWSIDLTSATPTWERIDQSGDSPPTCCNFPVAVVGRSMYMFSGQSGAKITNNMYEFKFNERLWVRIPTEHLLKGDTAPPQRRYGHSMVAYAGQLYVFGGAADGILDNEVHCFNVETRNWSIIKPYDGSQVPSARVFHTAAVSRDCMYVFGGTVDSIASRSGELFRFKFSSFPPCTLIKDLTKLLHDLPLCDVHFIVGDKERNIIKAHAAIAAARSPYLRRKILEAYEKPSGEEELPPFIPSSPVEVTLGGVSTSTFSHSMYYMYTDRIHPELEAPPQGDQVLLMMELYKFSLLLEARRLELLCMQYLEASVNVDNVLLVLENASELNLQRLKEYCMKFIVRENNYRKIIMMQSFERLDHPLMVQIVRRQQYRSRPTSPSPESDDQPLPSTLQDDLRLFLLSDYGRPLSDIVLKVGDQKVLAHKPLLAARCSYFEAFFRSFMPSDNQIEISFGRTVPSQQAFQSLLKYVYYGDTDVPPEDALYIFSAPNFFGFSNNCLHIHCKAILEQNISISNVVSLLEASDLISLAEMKEHCLKLISEHFPSLVHQPEFRDLNKSLLLDVLEVIAKKIA

SEQ ID NO: 8482 - protein, 827 aa, Capsaspora owczarzaki
  MOD_RES (170)..(181): Any amino acid
  MOD_RES (399)..(444): Any amino acid
  MOD_RES (465)..(477): Any amino acid
LSLDFRAEPMYRWKRMAGCTMAPSRSKHTMVAHGNSLFAFGGDDGHKMLNDLLRFDIEKGVWSKMSVEGKSPSPRYHHSAVVFGNSMFVFGGYTGDLYSNTNLENRNDLFEYRFDLNSWQEWSTVGARPVARSAHSACVYGDYLYIFAGYDGKARLNDMWRIRLSPEESXXXXXXXXXXXXHEWQEVSQSGNHPPTCCNFPMAVASDSMFVFSGHSGAKTSNDLFEFEFSTGRWTKLTHRHMIDGGDPPPPRRFGHTMVAFGNHLYIFGGSADNALPGDVMAYDLQADIWRAVEPHGNSQIPTGRCFHACAVVDSGMFVFGGTVDFSQNIKSTDLFRFQLAVIPSCSLHSDYARFYQSGELTDLVFKIGPEQKSIRAHVAMVAARSKYLRELILRKRGXXXXXXXXXXXXXXXXXXXXXXXXXXXXXXXXXXXXXXXXXXXXXXTVAQDVEQTKGARSDAHAPSXXXXXXXXXXXXXPPTDYATAPVLELHFPNANFAAFELVIAFIYSDTISHVEYNSNLGAINIEMITHAYELAIQFNLARLEKLCELLILAAVTVKNVLSVLRIVSALKLGNLKSDCLNFIVREGNYSEIVGSPELEQLEQGLLVEIVRRQQMPQQREQKLSPVDSPEGSLDLDMSNFFQGMTGAYFFDVSFVVHGEVFFAHKSILAARAEYFRAMFRSGMQESKTTRLSAAIGDVMPSRSAFASLMWYIYCGDVGMPPEDAMYLFSAPHFYGFTNDRLQAFCKYNLEENVSPRNVLQILEAADRIQAHDMKRHALHVTVECFSKIAQSAKLKSLKKELLLEILNALGEKMTNCQCSHSAGSAS

SEQ ID NO: 8483 - protein, 218 aa, Homo sapiens
  MOD_RES (62)..(86): Any amino acid
  MOD_RES (115)..(121): Any amino acid
CYPKCTLHEDYGRLWESRQFCDVEFVLGEKEECVQGHVAIVTARSRWLRRKITQARERLAQXXXXXXXXXXXXXXXXXXXXXXXXXLHVAIREAEARPFEVLMQFLYTDKIKYPXXXXXXXVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTP

SEQ ID NO: 8484 - protein, 200 aa, Homo sapiens
LDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 8485 - protein, 201 aa, Homo sapiens
KNQRTITVNPAHMGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWI

SEQ ID NO: 8486 - protein, 210 aa, Homo sapiens
  MOD_RES (78)..(83): Any amino acid
GPEAEDFECSSHCSELSWRQNEQRRQGLFCDITLCFGGAGGREFRAHRSVLAAATEYFTPLLSGQFSESRSGRVEMPXXXXXXGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWV

SEQ ID NO: 8487 - protein, 204 aa, Homo sapiens
SGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 8488 - protein, 203 aa, Homo sapiens
MAEGSAVSDPQHAARLLRALSSFREESRFCDAHLVLDGEEIPVQKNILAAASPYIRTKLNYNPPKDDGSTYKIELEGISVMVMREILDYIFSGQIRLNEDTIQDVVQAADLLLLTDLKTLCCEFLEGCIAAENCIGIRDFALHYCLHHVHYLATEYLETHFRDVSSTEEFLELSPQKLKEVISLEKLNVGNERYVFEAVIRWI

SEQ ID NO: 8489 - protein, 51 aa, Artificial Sequence
  Description of Artificial Sequence: Synthetic polypeptide
RVQAENDFGKGEPEPESVIGYSGEDYTNSTSGDPVEKKDETPFGVSVAVGL

SEQ ID NO: 8490 - DNA, 147 bp, Artificial Sequence
  Description of Artificial Sequence: Synthetic polynucleotide
agatccaggctgaaaatgacttcgggaagggccctgagccagagtccgtcatcggttactccggagaagattagatccgagtccaggctgaaaatgacttcgggaagggccctgagccagagtccgtcatcggttactccggagaag

SEQ ID NO: 8491 - DNA, 24 bp, Artificial Sequence
  Description of Artificial Sequence: Synthetic oligonucleotide
  CDS (1)..(24)
tccggagaagattacactaacagc

SEQ ID NO: 8492 - protein, 8 aa, Artificial Sequence
  Description of Artificial Sequence: Synthetic peptide
SGEDYTNS

SEQ ID NO: 8493 - protein, 1231 aa, Artificial Sequence
  Description of Artificial Sequence: Synthetic polypeptide
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 8494 - DNA, 24 bp, Artificial Sequence
  Description of Artificial Sequence: Synthetic oligonucleotide
atgttgagcacatgcactgggcca

SEQ ID NO: 8495 - protein, 747 aa, Artificial Sequence; identical to SEQ ID NO: 8457
  Description of Artificial Sequence: Synthetic polypeptide

---

What is claimed is:

1. A cDNA encoding an EGFR-Septin-14 fusion protein comprising an EGFR portion fused to a Septin-14 portion, wherein the EGFR portion comprises amino acids:

CTGPGLEGCPTNGPKIPSIATGMVGALLLLLVVALGIGLFMRRRHIVRKR

TLRRLLQERELVEPLTPSGEAPNQALLRILKETEFKKIKVLGSGAFGTVY

-continued

KGLWIPEGEKVKIPVAIKELREATSPKANKEILDEAYVMASVDNPHVCRL

LGICLTSTVQLITQLMPFGCLLDYVREHKDNIGSQYLLNWCVQIAKGMNY

LEDRRLVHRDLAARNVLVKTPQHVKITDFGLAKLLGAEEKEYHAEGGKVP

-continued

IKWMALESILHRIYTHQSDVWSYGVTVWELMTFGSKPYDGIPASEISSIL

EKGERLPQPPICTIDVYMIMVKCWMIDADSRPKFRELIIEFSKMARDPQR

YLVIQ (amino acids 628-982 of SEQ ID NO: 5);

and wherein the Septin-14 portion comprises amino acids:

LQDKFEHLKMIQQEEIRKLEEEKKQLEGEIIDFYKMKAASEALQTQLSTD

TKKDKHRKK (amino acids 983-1041 of SEQ ID NO: 5).

2. The cDNA of claim 1, wherein the cDNA encoding the EGFR-Septin-14 fusion protein comprises SEQ ID NO: 2, or SEQ ID NO: 4 or has a genomic breakpoint comprising SEQ ID NO: 4.

3. The cDNA of claim 1, wherein the EGFR-Septin-14 fusion protein comprises a breakpoint LVIQLQDK (SEQ ID NO: 3) between the EGFR portion and the Septin-14 portion.

4. The cDNA of claim 1, wherein the EGFR portion comprises amino acids:

MRPSGTAGAALLALLAALCPASRALEEKKVCQGTSNKLTQLGTFEDHFLS

LQRMFNNCEVVLGNLEITYVQRNYDLSFLKTIQEVAGYVLIALNTVERIP

LENLQIIRGNMYYENSYALAVLSNYDANKTGLKELPMRNLQEILHGAVRF

SNNPALCNVESIQWRDIVSSDFLSNMSMDFQNHLGSCQKCDPSCPNGSCW

GAGEENCQKLTKIICAQQCSGRCRGKSPSDCCHNQCAAGCTGPRESDCLV

CRKFRDEATCKDTCPPLMLYNPTTYQMDVNPEGKYSFGATCVKKCPRNYV

VTDHGSCVRACGADSYEMEEDGVRKCKKCEGPCRKVCNGIGIGEFKDSLS

INATNIKHFKNCTSISGDLHILPVAFRGDSFTHTPPLDPQELDILKTVKE

ITGFLLIQAWPENRTDLHAFENLEIIRGRTKQHGQFSLAVVSLNITSLGL

RSLKEISDGDVIISGNKNLCYANTINWKKLFGTSGQKTKIISNRGENSCK

ATGQVCHALCSPEGCWGPEPRDCVSCRNVSRGRECVDKCNLLEGEPREFV

ENSECIQCHPECLPQAMNITCTGRGPDNCIQCAHYIDGPHCVKTCPAGVM

GENNTLVWKYADAGHVCHLCHPNCTYGCTGPGLEGCPTNGPKIPSIATGM

VGALLLLLVVALGIGLFMRRRHIVRKRTLRRLLQERELVEPLTPSGEAPN

QALLRILKETEFKKIKVLGSGAFGTVYKGLWIPEGEKVKIPVAIKELREA

TSPKANKEILDEAYVMASVDNPHVCRLLGICLTSTVQLITQLMPFGCLLD

YVREHKDNIGSQYLLNWCVQIAKGMNYLEDRRLVHRDLAARNVLVKTPQH

VKITDFGLAKLLGAEEKEYHAEGGKVPIKWMALESILHRIYTHQSDVWSY

GVTVWELMTFGSKPYDGIPASEISSILEKGERLPQPPICTIDVYMIMVKC

WMIDADSRPKFRELIIEFSKMARDPQRYLVIQ (amino acids 1-982 of SEQ ID NO: 5).

5. The cDNA of claim 3, wherein the EGFR portion comprises amino acids:

MRPSGTAGAALLALLAALCPASRALEEKKVCQGTSNKLTQLGTFEDHFLS

LQRMFNNCEVVLGNLEITYVQRNYDLSFLKTIQEVAGYVLIALNTVERIP

LENLQIIRGNMYYENSYALAVLSNYDANKTGLKELPMRNLQEILHGAVRF

SNNPALCNVESIQWRDIVSSDFLSNMSMDFQNHLGSCQKCDPSCPNGSCW

GAGEENCQKLTKIICAQQCSGRCRGKSPSDCCHNQCAAGCTGPRESDCLV

CRKFRDEATCKDTCPPLMLYNPTTYQMDVNPEGKYSFGATCVKKCPRNYV

VTDHGSCVRACGADSYEMEEDGVRKCKKCEGPCRKVCNGIGIGEFKDSLS

INATNIKHFKNCTSISGDLHILPVAFRGDSFTHTPPLDPQELDILKTVKE

ITGFLLIQAWPENRTDLHAFENLEIIRGRTKQHGQFSLAVVSLNITSLGL

RSLKEISDGDVIISGNKNLCYANTINWKKLFGTSGQKTKIISNRGENSCK

ATGQVCHALCSPEGCWGPEPRDCVSCRNVSRGRECVDKCNLLEGEPREFV

ENSECIQCHPECLPQAMNITCTGRGPDNCIQCAHYIDGPHCVKTCPAGVM

GENNTLVWKYADAGHVCHLCHPNCTYGCTGPGLEGCPTNGPKIPSIATGM

VGALLLLLVVALGIGLFMRRRHIVRKRTLRRLLQERELVEPLTPSGEAPN

QALLRILKETEFKKIKVLGSGAFGTVYKGLWIPEGEKVKIPVAIKELREA

TSPKANKEILDEAYVMASVDNPHVCRLLGICLTSTVQLITQLMPFGCLLD

YVREHKDNIGSQYLLNWCVQIAKGMNYLEDRRLVHRDLAARNVLVKTPQH

VKITDFGLAKLLGAEEKEYHAEGGKVPIKWMALESILHRIYTHQSDVWSY

GVTVWELMTFGSKPYDGIPASEISSILEKGERLPQPPICTIDVYMIMVKC

WMIDADSRPKFRELIIEFSKMARDPQRYLVIQ (amino acids 1-982 of SEQ ID NO: 5).

6. The cDNA of claim 1, wherein the Septin-14 portion consists of amino acids:

LQDKFEHLKMIQQEEIRKLEEEKKQLEGEIIDFYKMKAASEALQTQLSTD

TKKDKHRKK (amino acids 983-1041 of SEQ ID NO: 5).

7. The cDNA of claim 3, wherein the Septin-14 portion consists of amino acids:

LQDKFEHLKMIQQEEIRKLEEEKKQLEGEIIDFYKMKAASEALQTQLSTD

TKKDKHRKK (amino acids 983-1041 of SE0 ID NO: 5).

8. The cDNA of claim 1, wherein the EGFR portion consists of amino acids:

MRPSGTAGAALLALLAALCPASRALEEKKVCQGTSNKLTQLGTFEDHFLS

LQRMFNNCEVVLGNLEITYVQRNYDLSFLKTIQEVAGYVLIALNTVERIP

LENLQIIRGNMYYENSYALAVLSNYDANKTGLKELPMRNLQEILHGAVRF

SNNPALCNVESIQWRDIVSSDFLSNMSMDFQNHLGSCQKCDPSCPNGSCW

GAGEENCQKLTKIICAQQCSGRCRGKSPSDCCHNQCAAGCTGPRESDCLV

CRKFRDEATCKDTCPPLMLYNPTTYQMDVNPEGKYSFGATCVKKCPRNYV

VTDHGSCVRACGADSYEMEEDGVRKCKKCEGPCRKVCNGIGIGEFKDSLS

INATNIKHFKNCTSISGDLHILPVAFRGDSFTHTPPLDPQELDILKTVKE

ITGFLLIQAWPENRTDLHAFENLEIIRGRTKQHGQFSLAVVSLNITSLGL

RSLKEISDGDVIISGNKNLCYANTINWKKLFGTSGQKTKIISNRGENSCK

ATGQVCHALCSPEGCWGPEPRDCVSCRNVSRGRECVDKCNLLEGEPREFV

```
ENSECIQCHPECLPQAMNITCTGRGPDNCIQCAHYIDGPHCVKTCPAGVM

GENNTLVWKYADAGHVCHLCHPNCTYGCTGPGLEGCPTNGPKIPSIATGM

VGALLLLLVVALGIGLFMRRRHIVRKRTLRRLLQERELVEPLTPSGEAPN

QALLRILKETEFKKIKVLGSGAFGTVYKGLWIPEGEKVKIPVAIKELREA

TSPKANKEILDEAYVMASVDNPHVCRLLGICLTSTVQLITQLMPFGCLLD

YVREHKDNIGSQYLLNWCVQIAKGMNYLEDRRLVHRDLAARNVLVKTPQH

VKITDFGLAKLLGAEEKEYHAEGGKVPIKWMALESILHRIYTHQSDVWSY

GVTVWELMTFGSKPYDGIPASEISSILEKGERLPQPPICTIDVYMIMVKC

WMIDADSRPKFRELIIEFSKMARDPQRYLVIQ (amino acids 1-982 of SEQ ID NO: 5).
```

9. The cDNA of claim 3, wherein the EGFR portion consists of amino acids:

```
MRPSGTAGAALLALLAALCPASRALEEKKVCQGTSNKLTQLGTFEDHFLS

LQRMFNNCEVVLGNLEITYVQRNYDLSFLKTIQEVAGYVLIALNTVERIP

LENLQIIRGNMYYENSYALAVLSNYDANKTGLKELPMRNLQEILHGAVRF

SNNPALCNVESIQWRDIVSSDFLSNMSMDFQNHLGSCQKCDPSCPNGSCW

GAGEENCQKLTKIICAQQCSGRCRGKSPSDCCHNQCAAGCTGPRESDCLV

CRKFRDEATCKDTCPPLMLYNPTTYQMDVNPEGKYSFGATCVKKCPRNYV

VTDHGSCVRACGADSYEMEEDGVRKCKKCEGPCRKVCNGIGIGEFKDSLS

INATNIKHFKNCTSISGDLHILPVAFRGDSFTHTPPLDPQELDILKTVKE

ITGFLLIQAWPENRTDLHAFENLEIIRGRTKQHGQFSLAVVSLNITSLGL

RSLKEISDGDVIISGNKNLCYANTINWKKLFGTSGQKTKIISNRGENSCK

ATGQVCHALCSPEGCWGPEPRDCVSCRNVSRGRECVDKCNLLEGEPREFV

ENSECIQCHPECLPQAMNITCTGRGPDNCIQCAHYIDGPHCVKTCPAGVM

GENNTLVWKYADAGHVCHLCHPNCTYGCTGPGLEGCPTNGPKIPSIATGM

VGALLLLLVVALGIGLFMRRRHIVRKRTLRRLLQERELVEPLTPSGEAPN

QALLRILKETEFKKIKVLGSGAFGTVYKGLWIPEGEKVKIPVAIKELREA

TSPKANKEILDEAYVMASVDNPHVCRLLGICLTSTVQLITQLMPFGCLLD

YVREHKDNIGSQYLLNWCVQIAKGMNYLEDRRLVHRDLAARNVLVKTPQH

VKITDFGLAKLLGAEEKEYHAEGGKVPIKWMALESILHRIYTHQSDVWSY

GVTVWELMTFGSKPYDGIPASEISSILEKGERLPQPPICTIDVYMIMVKC

WMIDADSRPKFRELIIEFSKMARDPQRYLVIQ (amino acids 1-982 of SEQ ID NO: 5).
```

10. The cDNA of claim 1, wherein the EGFR-Septin-14 fusion protein consists of SEQ ID NO: 5.

* * * * *